United States Patent 10,301,643 (GENES AND USES FOR PLANT IMPROVEMENT) - sequence listing, part 5

SEQ ID NO: 19316 - protein, 424 aa, Glycine max
MPLETFIIICSWHLMFQVDILLCTDCFHDGRFVTGHSSIDFIRVDSTTDFGDLDGDSWTDQETLLLLEAVEVYNENWNEIAEHVGTKSKAQCILHFLRLPVEDGKLENINVSSLSLSSIVKNQEDNGRLHCCSNGDSAGPVHNSQDSDGRLPFANSGNPVMALVAFLASAVGPRVAATCAHAALAALSRNNSGSTSHIEAPDNDNRTNSESVHNRDGGHDGEVANSNQKNEDKSKVLGSCGQNEGGSTLLSAEKIKDAAKEGLSAAAMKAKLFADHEEREIQRLCANIVNNKLKRLELKLKQFAEIETQLMRECEQVEKVKQRLASDRSHIVSTRLGNGGTTPPMNVAGAGPSMVNNNSNGRQQMISASSSQPSISGYGNSQPVHPHMSFVPRPSMFGLGQRLPLSYDSTTTFSFFRSDVQWPR

SEQ ID NO: 19317 - protein, 67 aa, Oryza sativa
  unsure (1)..(67): unsure at all Xaa locations
FSRLQSFPQLKKLMNAYXPRQSVEMNAIAFPFNGRRLRGEQTPVELQMKNGGEINPLLPQIGGCLPP

SEQ ID NO: 19318 - protein, 610 aa, Heliobacillus mobilis
MGTRFLNEFGRLVHDKKETNLCQEVNSGGYAARKNLKYPTTDGKLPRVAYFCMEYGLHEELPIYAGGLGVLAGDYLKAAHDSGLPMVAIGILWNQDYTHQFIGEQGRPYDTYPNIRFDSVKDTGVTVQVRVRGADVVCKVHKVDSYGNVPLYLLDTNFPGSEHGWMTNRLYGGSGQDRVAAEIILGIGGIRALRALGIEVDLYHLNEGHATFCGFELIREKMTHYGMTFHQAWEDVRKELIFTTHTPVEAGNEVHGHDLLRLMEAYNGLTYEQVKDIGGDPFNMTVAALRLSHIANGVSKLHGQTACKMWSDVHNAACIISVTNGVHNRTWQDHSISDAFEHKGDLWEAHLNNKYRLVDYIERHRNVRLNPDNLIVGFARRAAPYKRSDLIFRTAEVIEPLLQERKLQLVFSGKAHPNDGIGKDIIQQLVRMSEKYGNSVVFLENYNMEVARYMVRGCDVWLNNPRRPLEASGTSGMKAAMNGVLNLSTVDGWVGEGLQHQVSGWLINPDIEAHLQEWEQDERDLRELYRVLLNEVIPTYYNNRNYWIQMMRASIDMARWQFSSHRMIREYFDLMYELTRDAQEMDLTSMPMHHPEMDRTESPFPSPYNQ

SEQ ID NO: 19319 - protein, 413 aa, Psilosiphon scoparium
  unsure (1)..(413): unsure at all Xaa locations
AIXGEXSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFXIEGVNRAQAGTGEIKGHYLNVTAGTMEEMYQRAEFAKELGSVICMIDLVIGYTAIQTMAVWARKTDMILHLHRAGNSTYSRQKIHGMNFRVICKWMRMAGVDHIHAGTVVGKLEGDPLMIXGFYNTLLLSHLDIBLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKNISFNY

SEQ ID NO: 19320 - protein, 370 aa, Zea mays
SLRHTCTGVAIDRRNAPPPPDAAAEKDESTQGLQLPEDIRWERLDKARFFVVGAGLFSAVSAALYPAVVLKTRLQVAPAAAAAESAALPLSAVAAATAILRQEGALAFYRGFATSLAGTIPARALYMGALEATRSAVGPAALSFGAAEPAASAAAGAVAGLAAAVAAQVVWTPVDVISQRLMVQGNPCPASRYHGGLDAFRKTVASDGLRGLYRGFGMSILTYAPSNAVWWATYSLSQKIIWSGIGCYLCDYGVGVQEIDLGDGDSLLQPGCKTVMVVQGVSAAMAGGASAFVTMPLDTIKTRMQVMDGDGEPITVGRTVRRLIKEGGLAACYRGLGPRWASMSLSATTMITTYEFLKRLSDKGQGSDLA

SEQ ID NO: 19321 - protein, 194 aa, Haemophilus somnus 2336
MATLLKIGLVSVSDRASQGVYQDQGIPELLEWLKSALCDPFEVESRLIPDEQTLIEKTLCELVDDCHCHLVLTTGGTGPVKRDVTPDATLAVADREMPGFGEQMRQVSLHFVPTAILSRQVGVIRRNSLILNLPGQPKAIKETLEGVKDEHGNVIVKGIFSAVPYCLQLIDGIYIDTDPNVIESFRPKSARRTL

SEQ ID NO: 19322 - protein, 512 aa, ASPERGILLUS NIDULANS FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 19323 - protein, 479 aa, Chlamydophila pneumoniae CWL029
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 19324 - protein, 564 aa, Saccharomyces kluyveri
MSEITLGRYLFERLNQVEVQTIFGLPGDFNLSLLDKIYEVPGMRWAGNANELNAAYAADGYARIKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNTVLELIKDAKNPVILADACASRHNVKSETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSQVGEVVKDYKPVAVPAKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLKPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQE

SEQ ID NO: 19325 - protein, 835 aa, Thermococcus kodakaraensis
MIFGKEDEKVDEIKLRVAEALKRDVGRGIVRFDRKYQRKLGVEPGDIVALKGERVTAAIVANAHPDDRGLDIIRMDGYIRRNAGVSIGDYVTVSRAEVQEAKKVVLAPAQKGVFIQIPGEIVKQNLLGRPVVKGDLVVAGGQNEAVYSPFDELLRGFFEAMPIGFGELKFVVVNTVPKGIVQITYNTEVEVLPQAVEVKEESIPEVTYEDIGGLSDAIQKIREMVELPLKHPELFERLGIEPPKGVLLYGPPGTGKTLLAKAVANEANAHFIAINGPEIMSKFYGESEERLREIFKEAEENAPSIIFIDEIDAIAPKREEVVGEVEKRVVSQLLTLMDGLKSRGKVIVIAATNRPDALDPALRRPGRFDREIEVGVPDKQGRKEILQIHTRGMPLEPDYDKEAVLRVLREIREKGNFDAERVDKIIAEVENAKNESEVKEALKKDAEIYSEVRNRLIDKMLDELAEVTHGFVGADLAALAREAAMVVLRRLIKEGKISPEQERIPPEVLQELRVRRDDFYEALKMVEPSALREVLIEVPNVRWEDIGGLEDVKQELREAVEWPLKYPKAFERLGIEPPKGILLYGPPGTGKTLLAKAVANESQANFIAIRGPEVLSKWVGETEKRIREIFRKARQAAPTVVFIDEIDAIAPARGSEGDRVTDRLINQLLTEMDGIQENSGVVVIGATNRPDIIDPALLRPGRFDRLILVPAPDEKARLEIFKVHTRRVPLAGDVDLRELAKKTEGYTGADIAALVREAALIAMRRIMRELPREVVESESEEFLERLKVSKKDFEMAMKKVKPSVTPYMMEYYRSFEENRKKQAGKERGGPDYYTF

SEQ ID NO: 19326 - protein, 220 aa, Hafnia alvei
YDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLVKVLNDKFGIVEALMTTVHATTATQKTVDGPSHKDWRGGRGASQNIIPSSTGAAKAVGKVIPELNGKLTGMAFRVPTPNVSVVDLTARLEKPASYKDICAAMKAASEN

SEQ ID NO: 19327 - protein, 834 aa, Actinobacillus pleuropneumoniae serovar 1 str. 4074
MGNKALSPENIQQVKDAILYKMVFALGVEPREASKRNWLNAALRVVRDLSTESWLQTRRSQVANGSRRVYYLSMEFLMGRTFSNAMIAEGVYELIDAALKELGQNLEDIINEEGDPGLGNGGLGRLAACYMDSLAAMKIPAIGYGIRYEYGMFRQEIRNGEQVEQPDQWLENEFAWPYLRSSKRFPIRFGGRVWNEGSKVVWQPDEEIVAQAHDQLIPGFETTATNSLRLWSAHASGKGFGLADFNRGDYFSAMSHQNLSENVSRVLYPDDSTYNGRELRLRQEYFLCSASVQDIIRRHETECGSCVNLVDKVAIHLNDTHPTLAVPELMRILIDEKGYSWEQAWSMTRKIFYYTNHTLMSEALETWPVEMLGRILPRHLGIIFEINEWFLNEVREKFPGDEDLVQRVSLIDEHGDRRVRMAWVAVVASTKVNGVAKIHSDLMVESIFADFARIYPDRFTNVTNGVTPRRWLRIANPGLANILDKRIGTNWLTNLSELEKFNVFIDDADVQAEVAAVKYENKRKLAEYVEKNLGITLNPEAIFDVQVKRIHKYKRQQLNVLHIITLYNRILKNPNADWTPRVFIFAGKAASAYYAAKKVIRLINDVANVINNDERIRDLIKVVFIPNYGVSLAQMIIPAADVSEQISLAGTEASGTSNMKFALNGALTIGTLDGANVEILDCVGKDNIFIFGNTVEQVEELRRNGYSPYHYYETDGELNEAVSQILNGKFSPDDPYRYQDLILNSGDYYQACADFRSYVEAQEKVAAAYRNKKAWTRSAIINIANMGYFSSDRSVLDYARDIWHIEPMDELQLKDNADLKSILESSNKLLGSRK

SEQ ID NO: 19328 - protein, 194 aa, Zea mays
ILYSRSADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFRYAFTS

SEQ ID NO: 19329 - protein, 1160 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYEIMRSEDNVACEKRTGGPTGELCICKTDVFTCQVFCFCLRDYAVSLCNIAEKLGCISPVCTLLCNVVRLVRFKSSNKSNFYYEPCNFVKPLLTIELGWLTEQSKLEGISGRVIAMRRVAISRPVARRVNFNLMKPAAAAALLLPPPPPSSREGSAPQTRAEPRSTMSADSAAAGRDALLDELRALMAAHSPSLHALVVPSEDAHQSEYVSERDKRRQFVSGFTGSAGLALITMKEALLWTDGRYFLQAEQQLTNRWKLMRMGEDPPVEVWIADNLSDEAVIGINPWCISVDTAQRYEHAFSKKHQTLFQLSSDLVDEIWKDRPPVNALPVFVQPVEYAGCSVTEKLKELREKLQHEKARGIIIAALDEVAWLYNIRGNDVHYSPVVHSYSIVTLHSAFFYVDKRKVSVENRSHDFEGHVVNCGSCLVQVQNYMTENGIDIKDYNMVQSDASLLASGQLKGSAVNGSSHGENDMNENSKVWIDSNSCCLALYSKLDQYQVLMLQSPIALPKAVKNPVELDGLRKAHIRDGAAVVQYLAWLDKQMQENYGASGYFTEAKGSQKKEHMNVKLTEVSVSDKLEGFRASKEHFKGLSFPTISSVGPNAAVIHYKPEASSCAELDADKIYLCDSGAQYLDGTTDITRTVHFGKPSEHEKSCYTAVLKGHIALDTAVFPNGTTGHAIDILARTPLWRSGLDYRHGTGHGIGSYLNVHEGPHLISFRPSARNVPLQASMTVTDEPGYYEDGSFGIRLENVLIVKEANTKFNFGDKGYLAFEHITWTPYQTKLIDTTLLTPAEIEWVNAYHSDCRKILQPYLNEQEKEWLRKATEPIAASC

SEQ ID NO: 19330 - protein, 223 aa, Saccharomyces cerevisiae
MSSEDYGYDYDLLFKIVLIGDSGVGKSNLLSRFTKNEFNMDSKSTIGVEFATRTLEIDGKRIKAQIWDTAGQERYRAITSAYYRGAVGALIVYDISKSSSYENCNHWLSELRENADDNVAVGLIGNKSDLAHLRAVPTEESKTFAQENQLLFTETSALNSENVDKAFEELINTIYQKVSKHQMDLGDSSANGNANGASAPNGPTISLTPTPNENKKANGNNCC

SEQ ID NO: 19331 - protein, 480 aa, Caloglossa stipitata
  unsure (1)..(480): unsure at all Xaa locations
KQLKNERYESGVIPYAKMGYWEPEYVIKETDVLALFRVSPQPGVDPIEAAAAVAGESSTATWTVVWTDLLTACDLYRAKAYKVDAVPNTSDQYFAYISYDIDLFEEGSIANLTASIIGNVFGFKAXXXXRLEDMRIPVAYLKTFQGPATGLIVERERMDKFGRPFLGATVKPKLGLSGRNYGRVVYEGLKGGLDFLKDDENINSQPFMRWKERFLYSIEAVNRSVAATGEVKGHYMNVTAATMENMYERAEFAKQLGSIIIMIDLVVGYTAIQTMGIWARRNDMILHLHRAGNSTYSRQKIHGMNFRVICKWMRMAGVDHIHAGTVVGKLEGDPLMIRGFYNTLLFSFLDINLPQGIFFQQDWASLRKVTPVASGGIHCGQMHQLLDYLGNDVVLQFGGGTIGHPDGIQAGATANRVALEAMVMARNEGRDYVAEGPQILRDAAKTCGPLQTALDLWKDITFNYTSTDTADFVETPTANV

SEQ ID NO: 19332 - protein, 686 aa, Bacillus circulans
APDTSVSNKQNFSTDVIYQIFTDRFSDGNPANNPTGAAFDGTCTNLRLYCGGDWQGIINKINDGYLTGMGVTAIWISQPVENIYSIINYSGVNNTAYHGYWARDFKKTNPAYGTIADFQNLIAAAHAKNIKVIIDFAPNHTSPASSDQPSFAENGRLYDNGTLLGGYTNDTQNLFHHNGGTDFSTTENGIYKNLYDLADLNHNNSTVDVYLKDAIKMWLDLGIDGIRMDAVKHMPFGWQKSFMAAVNNYKPVFTFGQWFLGVNEVSPENHKFANESGMSLLDFRFAQKVRQVFRDNTDNMYGLKAMLEGSAADYAQVDDQVTFIDNHDMERFHASNANRRKLEQALAFTLTSRGVPAIYYGTEQYMSGGTDPDNRARIPSFSTSTTAYQVIQKLAPLRKSNPAIAYGSTQERWINNDVLIYERKFGSNVAVVAVNRNLNAPASISGLVTSLPQGSYNDVLGGLLNGNTLSVGSGGAASNFTLAAGGTAVWQYTAATATPTIGHVGPMMAKPGVTITIDGRGFGSSKGTVYFGTTAVSGADITSWEDTQIKVKIPAVAGGNYNIKVANAAGTASNVYDNFEVLSGDQVSVRFVVNNATTALGQNVYLTGSVSELGNWDPAKAIGPMYNQVVYQYPNWYYDVSVPAGKTIEFKFLKKQGSTVTWEGGSNHTFTAPSSGTATINVNWQP

SEQ ID NO: 19333 - protein, 613 aa, Neurospora crassa
MHIREMLADAERTKAPSFSFEYFPPKTAQGVQNLYDRMDRMYNFGPKFIDITWGAGGRIAELTCEMVAQAQAYLGLETCMHLTCTDMGEEKVNNALQRAYKAGCTNILALRGDPPREKERWEAAEGGFQYARDLVAHIRKLYGDHFDIGVAGYPEGCDDNKDEESLLDHLKEKVDMGASFIVTQMFYDVDNFLRWVKRVRERGITIPIIPGIMPIATYASFIRRANHMNCKIPEEWMAKLEPVKNDDVAVREIGKTLVAEMCRKIVDAGIRHLHFYTMNLAQATRMVLEELDWLPSPNRPLKRALPWKQSLGSGRRDEDVRPIFWRNRNKSYITRTQDWDEFPNGRWGDSRSPAFGELDAYGIGLTGSNELNRKKWGEPQTVKDIANLFVRYLNQELEYLPWSEAPISSEAELIKDDLIALNNRGLITINSQPAVNGVKSTHPVHGWGPANGYVYQKAYLELLVSPELFPEIKRRIEDHPDITYYAVTKSGNLHTNAPSEGPNAVTWGVFPGKEIVQPTIVESISFLAWKDEAFQLGLEWARCYDADTPSRLLIEEIMDKWYLINIVNNDFHQPRTIFEILNDLSLPDLEKVYTPAHTNGATNGVPEASTVPQ

SEQ ID NO: 19334 - protein, 457 aa, Choristocarpus tenellus
DYNVKDTDILALFRITPQPGVDPVEAAAAVAGESSTATWTVVWTDLLTACDIYRAKAYRVDPVPNTANQFFAYVAYECDLFEEGSLANLTASIIGNVFGFKAISALRLEDMRIPFAYLKTFQGPATGLIVERERLDKFGRPLLGATVKPKLGLSGKNYGRVVYEGLRGGLDFLKDDENINSQPFMRWKERFLYCMEGVNRAAAGTGEVKGSYLNVTAGTMENMYERADYAKQIGTVIIMIDLVIGYSAIQSMAVYARKAQLILHLHRAGNSTYARQKNHGINFRVICKWMRMCGVDHIHAGTVVGKLEGDPLMVKGFYNTLLLTSLEIDLAQGIFFDMDWASLRKCVPVASGGIHCGQMHQLLYYLGDDVVLQFGGGTIGHPDGIQAGATANRVALESMVLARNEGVDYVEQGPEILRNAARVCGPLKAALDLWKDITFEYTSTDTPDFIETATEAK

SEQ ID NO: 19335 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGISGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 19336 - protein, 496 aa, Magnetospirillum magnetotacticum
MPLTPELDPFKLAKALSGKHLIGGKFVPAKGGKTFPVDNPATGEEIGTAAFGTKADVDAAVANAKAAQKEWAKQSARARGKLVAECGRVLSAHVEELGRLVALETGKALRTESRVEAGVLADMFVFFGGLGSELKGETIPFNPDMLTVTVREPVGVVGCIIPWNVPLLLMAMKAAAALVAGNAVVVKSAEEAPLTVLRVAEIMNTVLPPGLFNMLSGFGPECGAPLVEHPDVKKVTFTGSVETGRIVYKAAAEKLIPVTLELGGKSPMIVCADADMDQAVAGALAGMRFTRQGQSCTASSRLFVHESIHDEFVARVKAKVDAMVMGDPLDEKTDIGTIVSDGQLERVKSYIKLGEETKGATKHVCSAMPTDPKLAKGRFVQPVIFTGMKNSDRLCQEEIFGPVCAVIKWTDYEDVLAQANDSEYGLAASIWTRDFKVAMDATRRLEAGFVQVNQNLVVQPMLSYGGVKTSGIGKEASLESMLEHFTHKKTIIFNMK

SEQ ID NO: 19337 - protein, 213 aa, Haemophilus influenzae Rd
MSNPSCIIIAITGASASGKSSIASTVHKELCNELGCQEIGIITEDSYYKDQSHLEMTERVKTNYDHPNSMDRDLLIQHLKNLKNGSAVDVPVYSYVEHTRTNETTHFTPKRIVILEGILLLTDERVRQLADISVFVDTPLDICFIRRLQRDMEERGRSLQSVIDQYRATVRPMFLQFIEPSKQYADIVIPRGGKNRIAINMLKAQILHLLNQK

SEQ ID NO: 19338 - protein, 354 aa, Glycine max; identical to SEQ ID NO: 7440

SEQ ID NO: 19339 - protein, 158 aa, Uncinocarpus reesii
GAFDNERVVLPLTQYDIVIDRDSPRPGQQAFEKMTAGLYLGEIFRLVLLDLIDNKGNLIFEGQDASSLRKPYCLDSSFLAYIEEDPFENLSETKDLLERTLGLKATKPELELCRRLAELIGTRAARLSACGVAAICTKKNIKSCHVGADGSVFNKYPH

SEQ ID NO: 19340 - protein, 630 aa, Glycine max
MLRTNSATSLILEYLKQGEYFIPLRRDCRSCLHIPLHLSSQKNFSTVSKPGGASASGSPGKPPESNGTLSKFFIGSVALGAAFLAAYQTHYLDQYLKKEHYSVLQEPHVNATIEDLKSVQHSTDQLISPSEKFNHKNPTVEITEQKIDAHFSHPEIVVEDQVDKPIPVQDKSDIAEDVTAAAKENQLPEYPESSLTSDDPSKESVTQSDGIIGIQSTETVNARMEEGYHHASTSTQTSPDENGMKNIQPEQLEIQEMGRRESALGKDIEQQPTLLEEYHLRNKSERSPATYISSHDFTENSHFPEGKEALNGAMEELKDGYISENGKLVLDFLQAIHAAEKRQADLDAHAFNEEKKVLKEKYEKKLKDAAARELMLAEEAAMLDRELKRERAKASLAIKSLQEKMEEKLKTELEQKEIETDLKFKQTQELAKAELNAAIANEKAAQIEKMAEANVNINALCMAFYARSEEARQSHATQNFALRALALEDALSKGLPIETEIASLQSYLGSTDKDSVLDLFDALKGSVRHFSFFPPGGGGMLAHSLAHVASWLKVREDNQSGDGIESVINKVEVYLAEGKLAEAAACLEESVRGTQAAEIVAGWVRQARNRAISEQAVLLLQSYANSLSFT

SEQ ID NO: 19341 - protein, 433 aa, Glycine max
  unsure (1)..(433): unsure at all Xaa locations
MSFTATKFAPSPLPLNSTTPRSNDKPLSFSFDHSKPNPSSSFLGSTRKLLRFNALAKPHAHTRASSSPVAAVLLERTSNLLVTKEEGLELYEDMILGRFFEDKCAEMYYRGKMFGFVHLYNGQEAVSTGFIKLLKKEDSVVSTYRDHVHALSKGVPSRAVMSELXFGKATGCSRGQGGSMHMFSKEHNLIGGFAFIAEGIPVATGAAFSSKYRREVLKEADCDHVTLAFFGDGTCNNGQFYECLNMAALWKLPIVFVVENNLWAIGMSHLRATSDPQIWKKGPAFGMPWVHVDGXDVLKVKXVAKEAIXKTRPGEGPPLVECETYRFRGHSLADPDELRDPAEKAHYAGRDPISALKKYMIENKLASEQELKTIEKKIEEIVEDAVEFADESPHPPRSQLLENVFADPKGFGIGPDGKYRCEDPKFTQGTAHV

SEQ ID NO: 19342 - protein, 278 aa, Cladonia arbuscula
  unsure (1)..(278): unsure at all Xaa locations
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFXAKAG

SEQ ID NO: 19343 - protein, 303 aa, Oryza sativa
  unsure (1)..(303): unsure at all Xaa locations
MRNPPGRHLLRVATRAVRSSSALGSGGGGGGASTSATSPVAPSRPXAPPPPPSAIAAAACWESRTMRREGEEEWEEVVAGAEEAVHGAPVPVAEEEEEYRVVFWSPPTGDEVRAAFTSIEEVFGDPFRAHSYETEEQSALSTSVHSSSGNSSGSDDWIEPAAYALNSTALLTREHRNVLDAFRLLQKDPNVQKMVMSLSCDRAVWDAGTNNEAVQEFRRSFQDDKEAAGRKGNPGGPAGVLKWILGNTQAKIMEFMNNIMKIVNMLFHSDDDEAKPDLYTDAVKVSFMLSVFIFIVVAIARIN

SEQ ID NO: 19344 - protein, 860 aa, Oryza sativa
MPPRKATSSADARAKWRKRKRNANTSAADHSDDSDSAVAAAANDDNDDDDAALHAGTAAVNGGGGTLGGGDDDPVVDLREAEVHPTAIERVSAFPPAFRRVVNRLHPSVLAVMAAERAAAAAGAGAGGGGAAVPALENISHGQLQVLSSVLPDHPSLSNDPDKPSSYVCTPPLLMECRGVAKQFDGKLLMVPKHSDWFLPMTVHRLERQVLPQFFSGKSPGHTPEKYIMLRNRVITTYLERPARRLAFSECQGLVTSTPELYDLSRIVRFLDAWGIINYLAAGSVQRGLRMAATLIREEPTGELHLMSAPLKSIDGLILFDRPKCSVRAEDIASGASLSSSPGMENGDAGFDEKTLLERLSESFCSFCAQPLPSLHYESQKEADIALCSDCFHDARFVTGHSSLDFQRVDGKKDGLDNDGDSWTDQETFLLLEGIDKYKENWNAVAEHVGTKSKIQCLHHFLRLPVEDGLLENIKVPEASFSSKVQNNGFLHSNSNGSTSGLFIVSLLKNLTFFCVGYQFWLMQNASGSVFKLPQLFALGSLPQSGEAGDLPFINTANPVMSLISIMSLALLFRDDLQIAFLASSLGPRVAASCASEALIVLTGGDSRCYSNMQFYFNTDSSLAVSSENVRHAARCGLSAAATKCKLFADQEEREIQRLSATIINHQLKRLELKLKQFADIETYLLRDSEQSERMRQGLQAQRIRMMSGLRLASPRGNTMASNPLSQANIRPPGIPGSMPQAGTPAFYSNNMQVHPQMAFLQQGMQQQQQKQQQQQQMQLQQQQQQMQLQQQQQRQAFLQQQQQQMQQQQQQLQQQQQRQLQMLSFGGRLPLSAMNAPSTSAAPNVMFDNPDMPGPSNQG

SEQ ID NO: 19345 - protein, 211 aa, Brassica napus
VSKFTVGDVVGVGVIVGCCGRCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLASLKLDGKLILMGVINTPLQFITPLVILGR

SEQ ID NO: 19346 - protein, 617 aa, Geobacter metallireducens
MTVPQSITELDLKNLTNRTFHPSPVAWEDQVLYFLLLDRFSDGKETGYRDNRGRRVAKGETPLYQPGDAGNAIRTEPEAAVWRESGSRWCGGTLKGLASKMGYLKRMGVTAVWVSPLFKQCSFVPTYHGYGIQNFLEVDPHFGTADDLRELVHVAHANGIYVILDIILNHAGNIFAYDRGYTPYDGSTVYPVTGFRSADGTPNLPFGPIDTKANPDAWPDGAVWPRELQAANAYTRMGHIRDWDSYHEYLDGDFFDLKDIHLGEGEVDAFRPSPALLALCEVYKYWIALSDVDGYRIDTVKHMGAGATRFFASVIHEFAQAIGKENFYLIGEITGGRDNAFNTLATTGLNAALGVDDIPLRLEDLVKGRANPADYFNLFRNSLLVRKESHVWFRDKVVTVIDDHDQVCRGAKKERFCAGDPKWRRLVLNALALNTTTLGIPCVYYGTEQAFDGEGGDDRYLRECMFGGPFGAFRTRGVQFFDEENPVYREFAKILALRREKLPLRRGRQYLREISGDGVTFGLPYVIGGEIRSVVPWSRIFDTEEMVLAINTDADSPRTAWVLVDGSLHREGDRFAYRYSTDPGQVRGTTAVQRINDAVQAIQVTVPAAGFVMLEQR

SEQ ID NO: 19347 - protein, 461 aa, Oryza sativa
  unsure (1)..(461): unsure at all Xaa locations
MGQGTPGGMGKQGGLPGDRKPGDGGAGDKKDRKFEPPAAPSRVGRKQRKQKGPEAAARLPAVAPLSKCRLRLLKLERVKDYLPHGGGVSSSARKRLRPSEDKTEEEPILRSDDLRGTPMSVGSLEEIIDESHAIVSSSVGPEYYVGILPFVDMTQIETRFDFLMREKVLYVNALFKAEVDPIAYDTNVEKEQIGXLKRTLNGKDGNFRETRDSVEPTFIHTQNFKKMANRSHKGVRIYEWLCSGKTLLARAFANTASETFLXFVGRELIQEYLGDGPKLVRKLFTVADDHAPAIILIDDTAGVGRERNNAISDVLYQVLWILLQFLDQQDVLASKRIDVKNSVIATKSPFESDFGTSLSLSSHGRXIDRKIEFPXLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 19348 - protein, 462 aa, Xanthomonas axonopodis pv. citri str. 306
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 19349 - protein, 221 aa, Glycine max
  unsure (1)..(221): unsure at all Xaa locations
MSNVFEGYERQYCELSANLAKKCTAAGALNGEQKKQKVSEVKAGIDEAEALIRKMDLEARSLQPNIKGVLLAKLREYKSDLNNLKSEVKKIVSGNLNPSARDELLESGMADAMTASADQRTRLMVSTERLNKTSDRVKDSRRTMLETEELGVSILQDLHSQRQSLLHAHNTLHGVDDNIGKSKKILTNMSRRMNKNKWVIGGIVLVLVIAIIVILYFKXSK

SEQ ID NO: 19350 - protein, 475 aa, Nizymenia australis
NERYESGVIPYAQMGYWDPDYVVKDTDVLALFRVSPQPGVDAVEASAAVAGESSTATWTVVWTDLLTACDLYRAKAYKVDAVPNTSDQFLAYIAYDIDLFEEGSIANLTASIIGNVFGFKAVKALRLEDMRIPVAYLKTFQGPATGIIVERERMDKYGRPFLGATVKPELGLSGKNYGRVVYEGLKGGLDFLKDDENINSQPFMRWKERYLFSMEGVNRSIAAAGETKGHYLNVTAATMEHMYERAEFAKQLGSIIMMIDLVVGYTAIQTMAIWARKNDMILHLHRAGNSTYSRQKIHGMNFRVYCKWMRMAGVDHIHAGTVVGKLEGDPLMIRGFYNTLLLPYLAVNLPQGLFFEQEWASLRKVTPVASGGIHCGQMHQLLDYLGVDVVLQFGGGTIGHPDGIQAGATANRVALESMVIARNEGRDYVAEGLEILKDAAKTCGPLQTALDLWKNITFNYTSTDTADFVETPTAI

SEQ ID NO: 19351 - protein, 375 aa, Triticum aestivum
MMKSGEEVSQGQQMNDFSEEKAAGESGDGRKIETSPSINLNSLPAIAPATTEIGVLHGALESEANDASTHNGDESSGTDLLILLPVAVPVEAEVPPRAARKTASALPRHCASHAGEKDALVTVAENEGCADGGDNHKGVHVLSIVKKDESEEIVDSINPVTVAEYREEKGTAGSTSAITAVRAPGSRSSCFHGVTRHRWSGKYEAHLWDSTCRVEGRRRKGKQVYLGSYDTEQKAARAYDVAALKFFGLNTKLNFSISEYEKELADIQDMSPEECVTYLRRRSSCFSRGASIYRGVTRRQKDGRWQARIGLIAGTRDIYLGTFKTEEEAAEAYDIAAIEIRGKNAVTNFDRSNYMDRGMHCIEGAGLKLLATKPE

SEQ ID NO: 19352 - protein, 773 aa, Oryza sativa
MPVADCESGLSPADVTGAGAANGNPGHWRSYYRHVLLLAYQSCGVVYGDLSTSPLYVYKSTFIIGSLRRFQDEEIVFGVFSLVFWTLTLIPLLKYVFIVLAADDNGEGGTFALYSLLVRHAKFSLMPNQEAADEELTSYYRPGYAPQETPILTALRRFLENHRKSRTFLLVTVLFGASLVIGDGVLTPPMSVLSSFSGLQVHSTALTSGEVEILSCTVLVCLFMVQHWGTHRVAFLFAPVVIVWLLLLGALGVYNIVVWNPRVLRALSPYYLVRDRSHVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVVPRPSDLARTGLLMREPGEEESVVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 19353 - protein, 192 aa, Microbulbifer degradans 2-40
MLLMIDNYDSFTYNVVQYLAELKADVLVVRNDELTVEQIKAKQPERIVISPGPCTPNEAGVSVEVIKQFAGVVPILGICLGHQSIGQAFGGDIIRARQVMHGKTSPMYHANVGVFEGLSNPFTATRYHSLVIDKNTLPECLEVTAWTQDEAGNIDEIMGVRHKELAIEGVQFHPESILSEHGHQLLKNFLER

SEQ ID NO: 19354 - protein, 441 aa, Pseudomonas syringae pv. tomato str. DC3000
MVNRLHGKSLLALLTLSALAPWAQAAETPVLNTGSTAWMITAAVLVLFMCLPGLALFYGGLVRAKNMLSLFTQCFGIAGVVGVLWVIYGYSMVVDTSNMVEGQVTFNSFVGGLSRAFLAGMTPDSLVGEIPEGVFVTFQMTFAIITPALIAGAFAERMKFSAALLFMALWFTLVYAPVAHMVWGGAGALMHNWGVLDFAGGTAVHINAGVAALAACLVLGKRKGYQNTPMPAHNLSLTMAGAAMLWVGWFGFNIGSGGGLSGTSGIVMLNTQVGACAGILGWMFTEWFKVGKPSALGLASGALAGLVGITPACAYVGVGGALAIGVLCGVFCYLSVTVLKKRLGYDDSLDVFGLHGIGGMIGAVLTGVFCVPALGGLVPEVTMGAQVIAQVKGVLFTTVYCFAVSWIILKAVNALIGLRAHESVEEMGLDLAEHNERAYNH

SEQ ID NO: 19355 - protein, 90 aa, Thermosynechococcus elongatus BP-1
MNTLPNPQTPLYNHGLPQIEAWLQQKGCVRDETDIHCWELEYPQWSARICLDIEELQVVYHDRLEGSVTQRSFKYSCPRAEVEEAIFAGP

SEQ ID NO: 19356 - protein, 103 aa, Oryza sativa
MDPCKFRPSSSFDTKTTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 19357 - protein, 411 aa, Solenostemon scutellarioides
MELQNSAQEMEAPTTITIKGILGLLMANTDAKENGKRVISLGIGDPTAYSCFHASNAAQEGVVECLRSAKFNGYAPTAGLPQTRQAIAEYLSRDLPYKLPAESVYVTAGCTQAIEIALSVLARPGANILLPRPCFPIYGLCASFRNIEVRYFDLHPEKGWEVDLQAVEDLADHNTVAMVIINPGNPCGNVYSYQHLKKVAETAKRLGIVVIADEVYGHLAFGANPFVPMGNFGSIAPVVTLGSLSKRWLVPGWRLGWLVINDPDGTLMSPKFVERIKKYCDICGGPATFIQAAVPEIVEQTQEVFFRKTINILRQTSDICCQKIEEIDGITCPTKPKGAMAFMVKLNISRMKDISDDIDFCFKLAKEESVIILPGIAVGLNNWLRITFAVEPSALEEAMERLKSFCIRHSY

SEQ ID NO: 19358 - protein, 217 aa, Oryza sativa
  unsure (1)..(217): unsure at all Xaa locations
AACHDAQRGRRAAEPNLVVSLGEMLIDFVPDVAGVSLAESGGFLKAPGGAPANVACAISKLGGSSAFVGKFGDDEFGHMLVDILKKNGVNAEGCLYYEHARTVLAFVTXLKASVERXFMFYRNPIAIVLVTVAFLNLFLLSLPSVPFFFFFICIHGPGLFFLFLCARVVYYFLGSFFPGTSSCCPFLFLFFCLCIVVFIILFPFFFLLLVRGGSFVC

SEQ ID NO: 19359 - protein, 294 aa, Pisum sativum
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFSKDQRQVKMFLYQILCGIAYCHSHRVLHRDLKPQNLLIDRSSNALKLADFGLARAFGIPVRTFTHEVVTLWYRAPEILLGSRHYSTPVDVWSVGCIFAEMINQRPLFPGDSEIDELFKIFRITGTPNEDTWPGVTSLPDFKSAFPKWPSKDLATLVPSLEPSGLDLLSSMLRLDPSRRITARGALEHEYFKDIKFVP

SEQ ID NO: 19360 - protein, 234 aa, Helicobacter pylori J99
MTKIAMANFKSAMPVFKSHAYLKELEKTLKPQHFDRVFVFPDFLGLLPNAFLHFTLGAQNAYPRDCGAFTGEITSKHLEELKIHTLLIGHSERRVLLKESPSFLKEKFDFFKGKNFKIVYCIGEDLTTREKGFRAVKEFLSEQLENIDLNYSNLIVAYEPIWAIGTKKSASLEDIYLTHGFLKQILNQKTPLLYGGSVNAQNAKEILGIDSVDGLLIGSASLELENFKTIISFL

SEQ ID NO: 19361 - protein, 473 aa, Clostridium tetani E88
MSADTSTKGGGMKKTLSLWNFFTIGFGAIIGTGWVLLVGDWMIIGGGPIAAMIAFLIGSLFLLPIGAVFGELTSAIPISGGIVEYVSRTFGNKPSYFTGWFLALGNGILCPWEAIAISSLVGEFIPALKVIPLYEVMGATVYLPPLLISLAFAIYVIRLNFKGASEAAKLQGFLTKLLLAGMVIAMIISLFRGGPKNLQPIYQPKASNARSIWAGILPVLVMTPFFYAGFDTIPQQAEEASEDLDWNKFGKVISMVLIASGIFYVICIYSFGTIVPWQKFVTYTIPALTILSVIGLKIFSKVMMLIAIMGPLGPMNSFFGATARILLAMGRKGQLPEKFKELDKNNGTPKTANILMATLTIIGPFLGKNMLVPLTNVSSLAFIFACFMVSLACLRMRRTEPNIKRPYKVPGGKVGIILACMSSLIIIGLLVIPGSPASLNFVEWMVVLTWFLIGFALMLIRGKKVETKDSGAN

SEQ ID NO: 19362 - protein, 310 aa, Arabidopsis thaliana
MSPKIPTLDFSREDLKPGTKYWESTRENIRQALEEYGCFIIDLKDKTPLDLLDRVFGSLVDLFDLPTQTKMKNKYDKPLNGYVGQIPALPLHESLGIDNATSLEATRSFTGLMWPQGNEHFSECLYKYAEFAAELDQMVTRMVFQSYNVEKYYDPYIESTTYLLRVLKNRAPNNENPTLGFVTHTDKSFTTILHQDQVNGLEMETREGERININLSSPSLFMVVAGDALMAWSNDRVWSPRHQVLVSGETDRYSLGMFAFNNGTLQVPEELIDHQHPLMYKPFDHLGLLRFYRTDTGYKSECPIKAYCGF

SEQ ID NO: 19363 - protein, 338 aa, Neurospora crassa
MSSSPTFKDKDEDLEAQVPLNPQPSNPTVRTEQEVSGTTKLLYLAVYFLCNISLTIYNKLILGKFSYPWLLTALHAGSASIGCYILLLQGRFTLTKLSLQQNIVLFLFSILFTVNIATSNVSLAMVSIPFHQIMRSTCPFFAVLIYRFRYGRSYPRDTYLSLIPLILGVGLATYGDYYFTAAGFLLTFLGVILAVVKTVATNRIMTGALALSPLETLLRMSPLACAQALVCAIASGELAGFKEQNPEGPSGALILTLAGNGLLAFCLNYSSFSTNKVAGAVTMTVCGNIKQCLTILLGIVLFGVKVGFLNGLGMVIALAGAAWYSVVELRSKTQKGGR

SEQ ID NO: 19364 - protein, 645 aa, Pseudomonas syringae pv. syringae B728a
MGQTRFATGRQLDLICLGRLGVDLYAQQVGALLEDVSSFAKYLGGSSANIAFGTARLGLRSAMLSRVGDDHMGRFLVESLAREGCDVSAIKRDPERLTAMVLLGLKDRETFPLVFYRENCADMALRAEDIDEQQIASSKALLITGTHFSTDQVFKASSQALDYAKKHDVKRVLDIDYRPVLWGLAGKADGETRFVADQKVSQHVQRILPRFDLIVGTEEEFQIAGGATDLLAALRRVRELTAATLVVKLGPQGCTVIHGAIPARLEEGAIYPGVQVEVLNVLGAGDAFMSGFLSGWLKEASDERCCQLANACGGLVVSRHACAPAMPTPAELDYLFNSPQPITRPDQDVALQRLHQVSVPRKQWRQLFIFAFDHRGQLVELAQQAGRDLGSISQLKQLFVQAVERVEADLRKRGIEADVGLLADQRFGQDSLNAATGRGWWVARPVEVQGSRPLAFEHGRSIGSNLLAWPQEQIIKCLVQYHPDDEPMLRLEQEAQIKALYDASKVSGHELLLEIIPPKDHPSPHPDVMLRSLKRLYNLGIYPAWWKIEAQSAQVWQQLDELIQQRDPYCRGVVLLGLNAPVEDLAAGFAEARHSRVCQGFAVGRTIFREPSRAWMAGEIDDATLISRVQSTFNWLIESWRESRA

SEQ ID NO: 19365 - protein, 468 aa, Azospirillum brasilense
MSDISKVFDLIKEHDVKYVDLRFTDPRGKLHHTAQHVSTIDEDVFEDGIMFDGSSIAGWKAINESDMILQLDPTTAVMDPFSAQPTLNILCDVYEPSTGQPYARCPRGIAKAAEKYMASAGIADTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGLDGIQNKIHPGEAMDKNLYDLPAEELAKVPTVCGSREALDSLKADSAFLQKGDVFTKDMIESYIDLRTEELLAFETMPHPIEYKMYYSV

SEQ ID NO: 19366 - protein, 104 aa, Hordeum vulgare subsp. vulgare
MGRSPCCEKEHTNKGAWTKEEDQRLIAYIRANGEGCWRSLPKAAGLLRCGKSCRLRWMNYLRPDLKRGNFTDDEDELIIRLHSLLGNKWSLIAGQLPGRTDNEI

SEQ ID NO: 19367 - protein, 719 aa, Geobacillus stearothermophilus
MKKKTLSLFVGLMLLIGLLFSGSLPYNPNAAEASSSASVKGDVIYQIIIDRFYDGDTTNNNPAKSYGLYDPTKSKWKMYWGGDLEGVRQKLPYLKQLGVTTIWLSPVLDNLDTLAGTDNTGYHGYWTRDFKQIEEHFGNWTTFDTLVNDAHQNGIKVIVDFVPNHSTPFKANDSTFAEGGALYNNGTYMGNYFDDATKGYFHHNGDISNWDDRYEAQWKNFTDPAGFSLADLSQENGTIAQYLTDAAVQLVAHGADGLRIDAVKHFNSGFSKSLADKLYQKKDIFLVGEWYGDDPGTANHLEKVRYANNSGVNVLDFDLNTVIRNVFGTFTQTMYDLNNMVNQTGNEYKYKENLITFIDNHDMSRFLSVNSNKANLHQALAFILTSRGTPSIYYGTEQYMAGGNDPYNRGMMPAFDTTTTAFKEVSTLAGLRRNNAAIQYGTTTQRWINNDVYIYERKFFNDVVLVAINRNTQSSYSISGLQTALPNGSYADYLSGLLGGNGISVSNGSVASFTLAPGAVSVWQYSTSASAPQIGSVAPNMGIPGNVVTIDGKGFGTTQGTVTFGGVTATVKSWTSNRIEVYVPNMAAGLTDVKVTAGGVSSNLYSYNILSGTQTSVVFTVKSAPPTNLGDKIYLTGNIPELGNWSTDTSGAVNNAQGPLLAPNYPDWFYVFSVPAGKTIQFKFFIKRADGTIQWENGSNHVATTPTGATGNITVTWQN

SEQ ID NO: 19368 - protein, 278 aa, Zea mays
KFKRNIKSWMRGALLGSGSFGMVYEGISDEGAFFAVKEVSLLDQGSNAQQSIFCLFQEIALLSQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNVEWTNAFFMIGRGEQPTIPNYLSKEAQDFIGQCVRVDPESRPSASQLLEHPFVNRPLRASFESSSPPAI

SEQ ID NO: 19369 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 19370 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 19371 - protein, 510 aa, Zea mays
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKKKNKVDKIVVLWTANTERYSNVCAGLNDTMENLLASVDKNEAEVSPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 19372 - protein, 134 aa, Rhodobacter sphaeroides
MTDEREKVVKSDAEWRAELSELAYKVTRKHGTERAGTHDDFPKEPGVFRCVGCGAPLFDQAQKFESGTGWPSFWAPIDPEAVETSVDRSFFMRRTEVHCARCEAHLGHVFPDGPQPTGLRYCMNGVAMTFEPKG

SEQ ID NO: 19373 - protein, 215 aa, Eremothecium gossypii
MASLLKSYEADFQATLEQCQRLLRQAQGEPVAQRNATLQTLEQHKDDLYDILDQMEVEVNNMVGDPARQVASRSALRDLRREAGMVKQQLRELMDARDRDALFPAGAADMDNEQRQQLLSNHAMLQQTGERLVDAMRLANETEGIGNQVMMDLRSQRETLEHSRQNLFLADSYVDKSVRTLKTMSRRLVANKFISYAIIAVLILLILMVLYSKFK

SEQ ID NO: 19374 - protein, 202 aa, Oryza sativa (japonica cultivar-group); identical to SEQ ID NO: 1492

SEQ ID NO: 19375 - protein, 231 aa, Sorghum bicolor
MGRGRVELKRIENKINRQVTFAKRRNGLLKKAYELSVLCDAEVALIIFSNRGKLYEFCSGQSITKTLERYEKHMRPDTAVQNKENELVQSSRNEYLKLKARVDNLQRTQRNLLGEDLGSLGIKELEQLEKQLDSSLRHIRSTRTQHMLDQLTDLQRREQMLCEANKCLRRKLEETSNQVHSKCGARCQLTRLRAATPPHSRPHHILAMDCSFIPWKLQQSQPCRSGSLLNI

SEQ ID NO: 19376 - protein, 459 aa, Gelidiella acerosa
DPDYQVKETDVLALFRVSPQPGVDPVEASAAVAGESSTATWTVVWTDLLTACDLYRAKAYKVVAVPNATDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTIIVMIDLVIGYTAIQTMAIWARKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALEAMVIARNEGRDYVAEGPQILRDAAKTCGPLQTALDLWKDITFNYTSTDTADYVETPTANV

SEQ ID NO: 19377 - protein, 305 aa, Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 19378 - protein, 375 aa, Saccharomyces pastorianus
MLRTSTLLTRRVHPSLFSRNILRLQSTAAIPKTQKGVIFYENNGKLHYKDIPVPQPKPNEILINVKYSGVCHTDLHAWHGDWPLAVKLPLVGGHEGAGVVVKLGSNVKGWKVGDLAGIKWLNGSCMTCEFCESGHESNCPEADLSGYTHDGSFQQFATADAIQAAKIQPGTDLAEVAPILCAGVTVYKALKEANLKAGDWVAISGAAGGLGSLAVQYATAMGYRVLGIDAGEEKEKLFKRLGGEVFIDFTKTKDMVSDIQEATKGGPHGVINVSVSEAAISLSTEYVRPTGTVVLVGLPANSYVKSEVFSHVVKSINIKGSYVGNRADTREALDFFTRGLIKSPIKIVGLSELPKVYDLMEQGKILGRYVVDTNK

SEQ ID NO: 19379 - protein, 398 aa, Brassica napus
MALKLNPLASQPYNFPSSARPPISTFRSPKFLCLASSSPALSSKEVESLKKPFTPPKEVHVQVLHSMPPQKIEIFKSMEDWAEQNLLTQLKDVEKSWQPQDFLPDPASDGFEDQVRELRERARELPDDYFVVLVGDMITEEALPTYQTMLNTLDGVRDETGASPTSWAIWTRAWTAEENRHGDLLNKYLYLSGRVDMRQIEKTIQYLIGSGMDPRTENNPYLGFIYTSFQERATFISHGNTARQAKEHGDLKLAQICGTIAADEKRHETAYTKIVEKLFEIDPDGTVMAFADMMRKKISMPAHLMYDGRDESLFDNFSSVAQRLGVYTAKDYADILEFLVGRWKIESLTGLSGEGNKAQEYLCGLTPRIRRLDERAQARAKKGPKVPFSWIHDREVQL

SEQ ID NO: 19380 - protein, 725 aa, Brucella melitensis 16M
MAEKIDLKPSAPWYRLNTTDEDWQNAEAADLLKWYSQMKLIRRFEEKILDFEKAGLVHGPAHASIGQEAAAVGAMSVLKTDDQINGTHRTHHQVLTKLINAQTPSDFDILQSDFTDGMHDAVYRLMAEIMGLNTGYCGGRGGSMHMRDAASGIAGTSAIVGGNIPHAAGYALADKILNRKGISVAFFGDGPSLQGATYEAMNIAALYRLPVIFYVENNLYAVSTHIQDATRETRIASRCPMLGFTGIECDGMDILSVHQAMREACRIIEEEGGPVVIEAQCYRYLHQSGSKSGSDFGYRTREEEEEWKSRDPIALAERRLKELGIAGDAEFLKLDERVTAAVQAAGERLTETAAGSNVLRIPDALWPSASSVDDGILGDGSEFSGAEFREIEDYQPDELEKMRFAAAASDVLGRAMEKDPTIIVIGEDVHRFAGGVSGFTRNALELFPDRVLAMPIAENGFTGVVLGAALRGLRPVVEIMFGDFCFVAADQIANGISKVRHMFGDGFPVPIVMRVRVSPHTGYGSQHSGDPSALFGMFPGWRVVSPTNAFDYIGLMNSALKSDDPVAVIEHVEFYQRESLVPRNDRDYCIPLGKAKIVRPGSACTVLATSVMVQASIKAAEEAGIDAEIIDMRSLDMFGIDWALIGASIGKTNRMVIAEQVASGLSLGRHWIAEIQKRFFNDLDHEVLHVTGSMASPVVSLVLNKAALGSADKVRSALEQITHSA

SEQ ID NO: 19381 - protein, 599 aa, Zea mays
CRPLQQETTLVWSFGRGAKKNRPGKKSRGRSTKTIISLSAGVSFLQIKKRQVEQRSQLASELRRDGSAERLQPASCRGRPRGVGGGDPRHRRRGDEGDDVKLRLLGYKQQLKRDLSVVANFSVSFSIVSVVTGVTTLFGTGLQFGGPATMVYGWPIAGAFTAAVGLAMAEICSAYPTSGGLYFWSARLCTHRRWGPFAAWLTGWFNVVGQWAVTTSVDYSLAQLIQVIILLATGGKNGGGYLASKYMVIGFHAAILLSHAVINSLPITFLSFFGQFAAAWNMLGVFVLMVAVPTVATERASAEFVFTHFNTDNGAGIRSNLYIFVLGLLMSQYTLTGYDASAHMTEETKNADKNGPIGIISAIGISILVGWGYILGVTFAVKDIPYLLSPDNDAGGYAIAEVFYLAFKSRYGSGAGGIVCLGVVAVAVYFCGMSSVTSNSRMAYAFSRDGAMPFSSVWHKVNKQEVPINAVWLSALVALCMALPSLGSLVAFQAMVSIATIGLYISYALPILFRVTLARKYFVPGPFNLGRYGVLVGWVAVLWVATITVLFSLPVTYPVTKDTLNYTPVAVGGLLFLVLASWLLSARHWFKGPVTNLDG

SEQ ID NO: 19382 - protein, 478 aa, Valeriemaya cruenta
IKNQRYESGVIPYAKMGYWDPNYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTASTMEDMYERAEFAKDLGTVIVMIDLVIGYTAIQSMGIWARKNDMILHLHRAGNSTYSRQKIHGMNFRVICKWMRMAGVDHIHAGTVVGKLEGDPLMIRGFYNTLLESHLDINLPQGIFFQQDWASLRKVTPVASGGIHCGQMHQLLDYLGVDVVLQFGGGTIGHPDGIQAGATANRVALESVLIAKNEGRSYVEEGPQILRDAAKTCGPLQTALDLWKDITFNYTSIDTADFVETPTANV

SEQ ID NO: 19383 - protein, 273 aa, Helicobacter pylori 26695
MIKKCLFPAAGYGTRFLPITKTIPKEMLPIVDKPLIQYAVEEAMEAGCEVMAIVTGRNKRSLEDYFDTSYEIEHQIQGTNKENALKSIRNIIEKCCFSYVRQKQMKGLGHAILTGEALIGNEPFAVILADDLCISHDHPSVLKQMTSLYQKYQCSIVAIEEVALEEVSKYGVIRGEWLEEGVYEIKDMVEKPNQEDAPSNLAVIGRYILTPDIFEILSETKPGKNNEIQITDALRTQAKRKRIIAYQFKGKRYDCGSVEGYIEASNAYYKKRL

SEQ ID NO: 19384 - protein, 528 aa, Candida tropicalis
MAIVDTAIDGINYFLSLSLTQQITILVVFPFIYNIAWQLLYSLRKDRVPMVFYWIPWFGSAASYGMQPYEFFEKCRLKYGDVFSFMLLGKVMTVYLGPKGHEFIYNAKLSDVSAEEAYTHLTTPVFGKGVIYDCPNSRLMEQKKFAKFALTTDSFKTYVPKIREEVLNYFVNDVSFKTKERDHGVASVMKTQPEITIFTASRCLFGDEMRKSFDRSFAQLYADLDKGFTPINFVFPNLPLPHYWRRDAAQRKISAHYMKEIKRRRESGDIDPKRDLIDSLLVNSTYKDGVKMTDQEIANLLIGVLMGGQHTSASTSAWFLLHLAEQPQLQDDLYEELTNLLKEKGGDLNDLTYEDLQKLPLVNNTIKETLRMHMPLHSIFRKVMNPLRVPNTKYVIPKGHYVLVSAGYAHTSDRWFEHPEHFNPRRWESDDTKASAVSFNSEDTVDYGFGKISKGVSSPYLPFGGGRHRCIGEQFAYVQLGTILTTYIYNFKWRLNGDKVPDVDYQSMVTLPLEPAEIVWEKRDTCMV

SEQ ID NO: 19385 - protein, 535 aa, Zea mays
GGAAMAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSASFKARFPAPAYAVDPAGSTPPQADFVWRIILMLGAMPAALTYYWRTKMPETARYTALVAKNAKQAAADMSKVLQVEISAGAAEEDAVAATATAPAPASASASFGLFSGEFLRRHGLHLLGTSSTWFLLDIAFYSQNLFQKDIFSAVGWIPKAATMNALEELFSIARAQSLIALCGTVPGYWFTVALIDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAA

SEQ ID NO: 19386 - protein, 344 aa, Pseudomonas fluorescens PfO-1
MIEGVMGNESINWDKLGFDYIKTDKRYLSYFRNGEWDKGTLTEDNVLHISEGSTALHYGQQCFEGLKAYRCKDGSINLFRPDQNAARMQRSCARLLMPHVSTEQFIEACKEVVRANERFIPPYGTGGALYLRPFVIGVGDNIGVRTAPEFIFSVFAIPVGAYFKGGLTPHNFQISTFDRAAPQGTGAAKVGGNYAASLMPGSQAKKAHFADAIYLDPLTHKKIEEVGSANFFGITHDNKFVTPNSPSVLPGITRLSLIELAKSRLGLEVVEGDVFIDKLSDFKEAGACGTAAVITPIGGISYNDHLHVFHSETEVGPVTQKLYKELTGVQTGDVEAPAGWIVKV

SEQ ID NO: 19387 - protein, 188 aa, Streptococcus pneumoniae TIGR4
MILLIDNYDSFTYNLAQYIGNFAEVQVLRNDDSKLYEEAEKADGLVFSPGPGWPVDAGKMEDMIRDFAGKKPILGICLGHQAIAEVFGGKLGLAPKVMHGKQSNINFEAPSVLYQGIEDGRAVMRYHSILIEEMPEDFEVTARSTDDQAIMGIQHKNLPIYGFQYHPESIGTPDGLSSIRNFIEEVVK

SEQ ID NO: 19388 - protein, 329 aa, Kluyveromyces lactis
MVKVAINGFGRIGRLVLRIALQRKALEVVAVNDPFISVDYAAYMFKYDSTHGRYKGEVTTSGNDLVIDGHKIAVFQEKDPANLPWGKLGVDIVIDSTGVFKELDSAQKHLDAGAKKVVITAPSKTAPMFVVGVNEDKYNGETIVSNASCTTNCLAPIAKIINDEFGIDEALMTTVHSITATQKTVDGPSHKDWRGGRTASGNIIPSSTGAAKAVGKVLPELQGKLTGMAFRVPTVDVSVVDLTVKLAKEATYDEIKAAVKKASQGKLKNVVGYTEDSVVSSDFLGDTHSTIFDASAGIQLSPKFVKVVAWYDNEYGYSERVVDLVEHVA

SEQ ID NO: 19389 - protein, 187 aa, Zea mays
QAESPGIEADKLTKVLYPNDNHAPGKRLRLMQQYFQCACAVSDILRRHRLAGRALHTLPDFEVIQLNDTHPTIAIPELLRLLLDEHSLSWDDAWHITSRTFAYTNHTLMPEALERWPASLLRELLPRHLQIIKQINRQLKQQVKQRWPNDSALWHKLAVVSDGEVRMANLCVVSCFAVNGVAALHSQ

SEQ ID NO: 19390 - protein, 2070 aa, Oryza sativa
MDCSMTSSILSANYNTILFEFGVILVTSKILYALLRKLYQPRIFSDLLLGIVLAQFRVLSLTNAINLVFGKIGGFVFAPYLFALGVEMDPSALLDAPTADAAVAYAGIFSTAVLVTLFHAPIMRPTSGIVHENSLRAFLALAAALANTASPVLTRLATDLKIAKTAVGRLAVGAGIASDMLTTMLIAIGSMIWRDTGTEGAASPLAQPALTAAVLAVVLMSGLVSRAMAEWVDGRNPEGRRMRGFDLSLVALVAATLCWFTSALRLDVNMAAFLVGLAFPSEGRVSRLLVSKINLVLSSFVLPLYVAHVCLSLRQTTDDIEAAGLRKDQGFRVYVMELPFPWWKVLFVTAMGTLGKLVGCAAAGLLRGLGWLEALALGLLLNVKGYFHVYCALAAFEAGIITDKSFMAIIFMVAVNVATTPMVGMAIASWARRSVQWRLMGLQHHDPATELRLVVGLQGPQDVATLAFLMEALRWGGGNGELAVYAVDMVQLTDQTAAAIVKGGGFDGVTVVDEEVSEMRKQIGEALDAYQGDDGAVRVRRVLALSSFTDMHSDICICAEEAMAALKVLQLAPCSVGILVDRHRHVDAAASQSQSQGVVVVFIGGADDREALTLASFMSKHASVRLTALRVVQNATAQARARARTSLFESSKSSRRAGASSSSSASSVLGQEEVQAQVDDKFFAEFYRKHVAGSKAIGYMEKHVGDGAELVAVLRALQAEYRLFVVGRGRDRRSVLTEGLEEWAECLELGPVGDILASSDFSSTASVLIVQQYDAKKHYKDRSMGGGDGDEVLLLPEPRPRRGLASWALDLLERAAVRLGHDASKPLYWLSGNFAPVHHETPPAPALPVRGHLPIGDLKGFYGLFMVQMQQLRKKLKVLDFTYGHGTANTALIYHHGKLMALSEADKPYVVKVLEDGDLQTLGLLDYDKRLKHSFTAHPKVDPFTDEMFAFGYSHEPPYCTYRVITKDGAMLDPVPITIPESVMMHDFAITENYSIFMDLPLLFRPKEMVKNGEFIYKFDPTKKARFGILQRYEKDDTNIRWFELPNCFIFHNANAWEEGDEVILITCRLENPDLDKVNGYQSDNLENFGNELIAKVAGIIKFDLHAEPEISGKKQLEVGGNVRGIFDLGPGRFGSEAIFVPREPGVSGEEDDGYLIFFVHDENTGKSEVNVIDAKTMSADPVAVVELPSRVPYGFHAFFINETSEAVAIAIVPWGGGAVAVAVAREVPVEYLYPPFNLTYFHFLDTNGVFLLSRNATFSAAVYNAGVDPSSDDNQSRFFFSVLHAASRTPVWTATAGTTILQSIVLSLTAQGLALSDPDPAADYAWSTPRLRAPVAALRLLDTGELALLDAANATLWSSFDHPTDTLLPAQPLLAGVLLTSPVSDQDLNPGAYRLMLTDTDALLQWATNNGSSFLTYWALSTDPNSVQDSNAAVHSMTANSSGLYLLAANGRDTVFRLRFPSPDANGDPCLLKLDSSGRLRALRLSTTSPRATLPTVWAAPTGGCDLPLPCRSLGLCTPGTNGSSCSCPDAFSTYSTGGCAPADGSALPLLADTCAPPPNFNYMTLGEGIGYFANKFASPDTSGEELPACRNLCSANCSCLGFFYRNSSKSCFLLNYRIGSLFRGDSDAAVGFIKTLPPASRRQGGGKGSSLSFITIVFGIALPTVAAVLIGFVVYVMWVKSRQASNKKKKKKQGGSRSWFKLPMLSSQQASYASEEQQGEEDDGDGDEVLIPGLPARFTGELTDPERSAVVAVKRMNNLGSQGRREFLTEMAVIGNAHHVNLVKLRGFCAEGARQLLVYEYMNRGSLDQCLFRAAAAPLEWPERMGVCVGAARGLAYLHAGCTRKILHCDVKPENILLNDRGGVKIADFGLAKLMSPEQSGLFTTMRGTRGYLAPEWLTNAPITDKADVYSFGMVLLEIVRGRKNCRSGKGSGGEASSDSDGYFPAMALELHEQGQYEAVVDQRLEGRADVAQVERVVRVALCCLHEDAALRPAMTTVSAMLDGSMEAGVPRTELLDYLRLYGRGLVDVRSGLHAAGKGGSDFTSGGAGSSSWSPTSCVSAQQLSGPR

SEQ ID NO: 19391 - protein, 119 aa, Trichodesmium thiebautii
PIEKHHHEVATAGQNEIACQFNTLVKKADEIQVYKYVVHNVAHAYGQTATFMPKPLVGDNGSGMHCHQSISKDGVNIFAGDKYAGLSEEALYYIGGIIKHARAINAFRNASTNSYKRLS

SEQ ID NO: 19392 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 19393 - protein, 370 aa, Saccharomyces cerevisiae
MNIQSNNSPNLSNNIVSKQVYYAHPPPTIDPNDPVQISFPTTEVVGHGSFGVVFATIIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLGFDENVELGHLSPDELSSVKKKLYPKSK

SEQ ID NO: 19394 - protein, 83 aa, Salmonella enterica
TNLFSGDKYAGLSEQALYYIGGVIKHAKAINALANPTTNSYKRLVPGYEAPVMLAYSARNRSASIRIPVVASPKARRIEVRFP

SEQ ID NO: 19395 - protein, 147 aa, Triticum aestivum
AIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYTAM

SEQ ID NO: 19396 - protein, 152 aa, Oryza sativa
  unsure (1)..(152): unsure at all Xaa locations
GTSVARVQGLKFTADLRESRRSTNWGFGGVSNGGRIKCMQVWSIEGMKKFETVSYLPALTVEDLLKQIACLFXSRWXPCVAFSTVGYAYRESHRSTGYXYDGRYWTMWKLPMFGCTDATQVLKELEEAKKAYPDALCPIIGXDNARQVQLIS

SEQ ID NO: 19397 - protein, 518 aa, Oryza sativa
MAGGAVVSTGAGKDYPGKLTLFVFFTCVVAATGGLIFGYDIGISGGVTSMDPFLRKFFPEVYRKKQMADKNNQYCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAHAFLTMLCHMKFGLFYFFAGWVVIMTAFIALFLPETKNVPIEEMVLVWKSHWFWRRFIGDHDAHVGAHHVSSPKLQP

SEQ ID NO: 19398 - protein, 558 aa, Mycobacterium tuberculosis CDC1551
MKVMAQMAMVMNLDKCIGCHTCSVTCKQAWTNRSGTEYVWFNNVETRPGVGYPRTYEDQERWRGGWVRDKKGRLRLRDGGRIHKLLRIFANPKLPTIGDYYEPWTYDYENLTSAPAGDTFPTAAPRSLISGNPMKVSWGSNWDDNLAGSPEIVPNDPVLKKVNQVNQEVKLKLEETFMFYLPRICEHCLNPSCVASCPSGAMYKRTEDGIVLVDQDRCRGWRMCVSGCPYKKVYFNHKTGKAEKCTLCYPRIEVGLPTVCSETCVGRLRYLGLVLYDVDQVLQAASVESDTDLYEAQRRILLDPHDPRVIAGARAEGIADEWIEAAQRSPVYALINTYRVALPLHPEYRTMPMVWYIPPLSPVVDAVSRDGHDGEDLGNLFGALDALRIPIAYLAELFTAGDTEVVAGVLRRLAAMRCYMRDINLGRETQPHIPESVGMTEEQIYQMYRLLAVAKYEERYVIPTSYVGELPAAAMTDDMGCSLSVDGGPGMYESGPFGQGSPTPVPIAVESFHALQHAGSAATGGAGRSRVNLLNWDPNGAAAGLFPEPQPSKDVVQR

SEQ ID NO: 19399 - protein, 314 aa, Arabidopsis thaliana
MFVAKNLSPERESKRQKKEPEIMEPSFPLLSPNNCGHWYIRYGFCIVCKSTVDKTIEGRVFDGLHLSSEALALTKRLITKFSCLNMKKLHLVLDLDLTLIHSVRVPCLSEAEKYLIEEAGSTTREDLWKMKVRGDPISITIEHLVKLRPFLCEFLKEANEMFTMYVYTKGTRPYAEAILKLIDPKKLYFGHRVITRNESPHTKTLDMVLADERGVVIVDDTRKAWPNNKSNLVLIGRYNYFRSQSRVLKPHSEEKTDESENNGGLANVLKLLKGIHHKFFKVEEEVESQDVRLLLKDIEFVRRRFMCKMISLSI

SEQ ID NO: 19400 - protein, 467 aa, GIBBERELLA ZEAE PH-1
MSASAIPEMNGGLESHVTVQKRAYYSPPWADVSIIGVAGSSGSGKSTLSQAIVKKLNLPWDSFYKTLTPEQSKMAFANEHDFDSPDAIDFDVLVEKLRDLKAGRRAEIPVYSFAKHARLDHTTSIYSPHVLVLEGIFALYDPRVIELLDMGIYCEADADTCLSRRLVRDVRERGRDIEGIIKQWFGFVKPNFEKFVEPQRKVADLIVPRGIENRVALDMMVQFVEKKLFEKSRHHREALSRLEAASKDSALSDRVVVLNDTRQLKFMNTILQDIDTDPEDFIFYFDRLASLIIEQALNNAHFEAKKIITPQGYEYKGLVPTGEVCAVIVLRGGSAFEPALRKTIPDCRTGRLLIQSDYSTGEPELHYLRLPDDIASQQSVLLLDTQMATGGAALMAVQVLVDHGVQQDRIVLATYSAGKVGLHRLTSVFPEITVVVCNMLDYQQERWVEKRYFRFNIGGRVGIGMTG

SEQ ID NO: 19401 - protein, 450 aa, Triticum aestivum
MSTCAASLAPLLGTAAANATDYLCNQFADTTTAIDSTYLLFSAYLVFAMQLGFAMLCAGSVRAKNTMNIMLTNVLDAAAGALFYYLFGFAFAFGTPSNGFIGKHFFGLRDVPQVGFDYSFFLFQWAFAIAAAGITSGSIAERTQFVAYLIYSAFLTGFVYPVVSHWIWSADGWASASRTSGPLLFNSGVIDFAGSGVVHMVGGVAGLWGALIEGPRIGRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAVTAGCSVVDPWAAIICGFVSAWVLIGLNKLAARFKFDDPLEAAQLHGGCGAWGVIFTALFARREYVEQIYGAPGRPYGLFMGGGGRLLGAHVVLILVIAAWVSCTMGPLFLALNKLGLLRISAEDQMAGM

SEQ ID NO: 19402 - protein, 366 aa, Bacillus cereus ATCC 14579
MQVKDQLSSLQPYKPGKSPEQMKEVYGDHSFVKLASNENPFGCSPRVLDELQKSWLEHALYPDGGATTLRQIIADKLHVKMEQVLCGSGLDEIIQIISRAVLRAGDNIVTAGATFPQYRHHAIIEGCEVKEVALNNGVYDLEEISSVVDNDTKIVWICNPNNPTGTYVNDRKLTQFIEGISENTLIVIDEAYYEYVTAKDFPETLPLLEKHKNILVLRTFSKAYGLASFRVGYAVGQEELIEKLNVVRLPFNVSSLAQKAATIAFGDDEFIEEIVRVNTEGLQQYESFCRENDIPFYPSQTNFIFLPVENAREIYEACAHAGFIIRPFPNGIRITVGTREQNEGVISVLQQHFENKKRKSRDEENA

SEQ ID NO: 19403 - protein, 96 aa, Zea mays
  unsure (1)..(96): unsure at all Xaa locations
PLGEGFVIRPPSRGNPGNPSIELGPEFKKGANFLGRVKAPPPKVELSSLKGFGEVWFGSGIPPKGKGAIFPQPGGKLGIPKGEGLXNKEVNGPEGF

SEQ ID NO: 19404 - protein, 294 aa, Glycine max
GDIKPSNVLLDRDFSPRIGDFGLARLSSETPRFEIEVLECGSGGDEEKMKKVYSFKKVVVVVADDCGSVESAHSVFMEDGGLGVEQSPSPEMAAMTSPETGLAVSAAEASPGFEKGSVQSEKEGVKKINGRGLKSNSVRDWWWKHENEVGVGESKKVKDYVMEWIGRDVNKERVKNGIEYGDVVVGKEEKNKKEKKRRKKELEWWESMEEEKLDGVMKRKRRTVREWWKEERFEENAKSSAKKKKKKRKGGSVKSDDEKCGDDWWMSDDAMDKRKGKSRSRNNRGNMDWWMDGL

SEQ ID NO: 19405 - protein, 1001 aa, GIBBERELLA ZEAE PH-1
MDGSAHLSGRNIDTGHELLNLLQSPFSGQLQAASLYSALATSLPVTIGIAIFFSILRPYHQAIYAPKLKHADEKHVPPPIGKAPWSWITTLWRTNEDMLLPLIGMDATVFLRFVRMCRNMFLTLCVTGIGILLPINVSRFKNYEGPKQTSWVISITPLTVYAPAIWSQVVIAWCFNFIVIGFLWFNYRKVHQLRRRYFESEDYQKSLHSRTLMVFDIPKKGCSDEGIARIIDQIAPNSSFARTAVARNVKELPALIEQHDHAVRKLEKILAKYLKDPNNVPTARPMCKPSKKDRSYGTYPRGQKVDAIEYYTQRIRDLEVQIKQVRATVDKRGSMPYGFASYADIAEAHGIAYACRKKKPVGATVKLAPRPNDIIWENMPLYSSTRGRRRWVNNMWITLLTLFWIVPNLGIAIFLVNLENLGKVWPAFQTELAAHPKVWGAIQGVLSPAIMSLTYLVLPMIFRRLSVKAGDQTKTGRERHVLAKLYFFFVFNNLFIFSIFSTVWSFVFSVVQDATGAKKEDAWESIKKQKIASGLFETLCNNSLFWVTYLLQRQLGAAIDLAQAWPLIQAFFLKKFSSPTPRELIELTAPPPFEYASYYNYFLYYATVTMCLAGIQPLVLPATALYFVIDSWLKKYLLLYRFVTKTESGGMFWRVIFNRFIFATILSNLVVMLTCWAHGNFGTHIEFWCVVPLPFIMLIFKIYCNRAFNDKITYYSIQDVTKSPENGVDPKENRMRSERLANRFGHPALYRPLITPMVHAKAQNLLPAIYKGRLTDGREVDSGDMMTGGKPGKAANNVPGFEFVNDTQMDFEYYKNRAEFAENHGGGEIYGRPGEIGRPGTPGSMDGSDFSRPGTPVGRSASPAAFPGGAAQQQRLMSLASNVSGDTSYSSYRPGANTGFTQQMTLGQEPPPARGRSPLYAQNNGSSSSLGLIQNAAAPAYSSNLNTPGRMTPAQSPGPSVGAMGGGPQGYSGLAQHEGGEQSYDYFRGSNRPRRNPGEGW

SEQ ID NO: 19406 - protein, 332 aa, Arabidopsis thaliana
MSTPTSRVSRPRSSADRSIADQKKIGHNASGPFGCGQARLTTTYKSKLSQRDGSVIKMKTSASSFGFDPTRVTQLSWTPRVFLYEGFLSDEECDHFIKLAKGKLEKSMVADNDSGESVESEVRTSSGMFLSKRQDDIVSNVEAKLAAWTFLPEENGESMQILHYENGQKYEPHFDYFHDQANLELGGHRIATVLMYLSNVEKGGETVFPMWKGKATQLKDDSWTECAKQGYAVKPRKGDALLFFNLHPNATTDSNSLHGSCPVVEGEKWSATRWIHVKSFERAFNKQSGCMDENVSCEKWAKAGECQKNPTYMVGSDKDHGYCRKSCKACSS

SEQ ID NO: 19407 - protein, 207 aa, Staphylococcus aureus subsp. aureus Mu50
MKATTIIGIAGGSGSGKTTVTNEIMKNLEGHSVALLAQDYYYKDQKHLTFDERLETNYDHPFAFDNDLLIENLKDLKNGKAVEVPTYDYASHTRSDITIDFKPKDVIIVEGIFALENKVLRDMMDVKIYVDTDADLRILRRLTRDTKERGRSMDSVINQYLSVVRPMHDQFIEPTKKYADIIIPEGGSNKVAIDIMTTKIQSLVSKQ

SEQ ID NO: 19408 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 19409 - protein, 186 aa, Desulfovibrio desulfuricans G20
MPCLPVPFFPPRILDLPTRVLIAIEYTHHPLAPQENPMPQKYRKTPEALAALTDEQRRVTQENGTERPFSNAFHDHTAAGLYVDIVSGEPLFSSLDKFDSGCGWPSFSRPVELNIVEKKDTSHGLVRTEVRSKHADSHLGHVFTDGPEHLTGLRYCINSAALRFIPADKLEEEGYGEYAHLFTTRE

SEQ ID NO: 19410 - protein, 209 aa, Zea mays
  unsure (1)..(209): unsure at all Xaa locations
MAGTSSWSSSSSCASSFGSPDHDVVCVTEPDSVGAVADAEGSVKFLCSYGGRILPRRTDGTLRYVGGDNRVLSVDRPIXLQRKLRELCGGWEAHLRCQLPTEDLDALISVTCDDDLAKLLEEYDEASKDRLQSLKIRAFLFPTRTPAPSILQRRSPPSIAHLHWQNTSPPPAAAGVSLTCAPRWWAAPQASRQAQAPQAQNYDRHSLGE

SEQ ID NO: 19411 - protein, 239 aa, Magnetospirillum magnetotacticum
MPDLDTIVRDIAEEMRARPDRGEVARYIPELAGVDPQAFGLVVIDGDGRAAVGGDADIPFSIQSISKVFTLTLALGMVGDRLWRRVGREPSGSPFNSIVQLERENGIPRNPFINAGAIAVTDVILSGHQPREALGEILRFMQFLAQDNGIAIDEKVAASEKRTGFRNAALANYMRSFGVIENPVDYTLGVYFHHCAIAMSCRQLATAGLYLAYSGLHPLADTRDLGRAARGQLNHGQVP

SEQ ID NO: 19412 - protein, 112 aa, Zea mays
  unsure (1)..(112): unsure at all Xaa locations
NPPKSFFRQMAAMAAQVPDWSKVVVAYEPVWAIGTGKTATPDQXAQEVHQQLREWFSKNVSPQVAESVRIIYGGSVTGANSQELARKPDIDGFLVGGASLKPEFVQIAKARD

SEQ ID NO: 19413 - protein, 466 aa, GIBBERELLA ZEAE PH-1
MSAVIDNGSDKDQPVKDVAQEVTEQSKPVSRFTRWYRSPLFNVIIVGLISFTQPGIWNALNNTGAGGQQEPYLVNGANSLTFGIMVFGCSFFSILANKIGLKWVLIIGTLGYAPYSAALYTNNRYGVEWFVLLGGATCGIGASALWASEGAIALGYGDIKDRGKFTGIWLGLRELGQLIGSSIQLSLNVHTGKRGRVGYTTYLVLIALQCLGLPLAFLISPPHKVIRSDGSKLPNTKTNKSIAEQFRKWGALIKRKQFFLLIPMLVGFNWNSTYLGIYLVNYFSVRSRALASLTSGVAATAANVFWGWFFDLKYFSRPQLARFTWAFLAVTMTALFGWQFAMEMEYRSANPHVTLDWALPGFGRGFAVQVLLRFMNESHYMFVYWIIGTFFQDVETLTLAVGLVRSFESLGSCLAFGVGAAKVPSLTNLIVAFAMFCISLPSTSFAVFLVPERPAENALDKPNEEE

SEQ ID NO: 19414 - protein, 334 aa, Corynebacterium efficiens YS-314
MTIRVGINGFGRIGRNFYRAVLERSDDLEIVAVNDLTDNKTLSTLLKFDSILGRLSEEVEYDDESITVGGNRIAVYAERDPKNLDWAAHNVDIVIESTGFFTDAQAAKAHIDAGAKKVIISAPASNEDATFVYGVNHQDYDPENHHVISGASCTTNCLAPIAKVLNDKFGIENGLMTTIHAYTGDQRLHDAPHKDLRRARAAAVNIVPTSTGAAKAVALVLPELKGKLDGYALRVPVITGSATDLTFTTNSDVTVESINAAIKEAATGELAETLAYTEEPIVSTDIVTDSHGSIFDAGLTKVSGNTVKVVSWYDNEWGYTCQLLRLTELVASKI

SEQ ID NO: 19415 - protein, 422 aa, Saccharomyces cerevisiae
MRISILQLVPVVGYIGFALGELYKPKNSISCSPNNPCPAEWPCCSPYNECGAGPICVGGCNVRSSFDEESCAPIPALVASQKLEFVSTPKVPKFIVNYQPKPPIREGNGPNKANTKVGVVEGELNSKRIIHYAKFLVTPDSKEAEKMLEDFDFTHSGYTSIEASSGNIVLAMPKKTTGSLITSTRSFLYGKASVRMKTARSRGVVTAFDLTSAIGDEIDFEWLGGDLMTAQSNYYSQGHLDYTRMQRFPVGADTWATYHTYEIDWDPDRIIWYVDGKIARTVLKKDTWDPISKEYRYPQTPMRLEIAVWPGGSETNGPGTINWAGGLIDWENSPDIIEKGQFTAHVEQITVTPYQNKFTEQVQFCIKAKKKAPTFSQKDLSRVVVSYNRQDRLNHHDEGSLKWDCFVTPKINDWLSSWKRSK

SEQ ID NO: 19416 - protein, 357 aa, Ocimum basilicum
MALQKVDISLSTEQLLQAQVHVWNHMYAFANSMSLKCAIQLGIPDILHKHGRPMTLSQLLQSIPINKEKTQCFQRLMRALVNSNFFIEENNSNNQEVCYWLTPASCLLLKEAPLTVTPLVQVVLDPTFTNPWHHMSEWFTHEKHATQFEAANGCTFWEKLANEPSKGRFFDEAMSCDSRLIAHVFTKDYKHVIEGIRTLVDVGGGNGTMAKAIVEAMPTIKCTVIDLPHVVAGLESTDNLNYIGGDMFQSIPSADAILLKSIIHDWDDVEGLKILKKCKDAVVMGGKVIIIDVVVGVNHDIDEVLEDQLHFDMAMMCYFNAKERTMSEWEKLIYDAGFKSYKLTPAFGVRSLIEAYP

SEQ ID NO: 19417 - protein, 485 aa, Grateloupia doryphora
NSVERTRIKNERYESGVIPYAKMGYWDPDYVIKDTDVLALFRITPQPGVDPVEASAAVAGESSTATWTVVWTDLLTACDLYRAKAYKVDAVPNSSEQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTASTMEDMYERAEFAKQLGTVIIMIDLVIGYTAIQSMGVWARKNDMILHLHRAGNSTYSRQKSHGMNFRVICKWMRMAGVDHIHAGTVVGKLEGDPLMIKGFYNTLLLTHLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 19418 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 19419 - protein, 316 aa, Zea mays
  unsure (1)..(316): unsure at all Xaa locations
MRLRGVLRLVLALLLAATAIVPVLLLSENGGGGVAPAPPFNSSRVKAVSWHPRIFVYKGFLSDAECDHLVTLAKKKIQRSMVADNESGKSVKSEVRTSSGMFLDKRQDPVVSRIEERIAAWTFLPQENAENMQVLRYEPGQKYEPHFDYFHDRVNQARGGHRYATVLMYLSTVREGGETVFPNAKGWESQPKDATFSECAHKGLAVKPVKGDAVLFFSLHADGTPDPLSLHGSCPVIRGEKWSAPKWIHVRSYEDEPQAVXCSPRKPTARGCADRSERCAKWAAAGECAWNPAYMLGAGDEGAPGQCRRSCGVCDS

SEQ ID NO: 19420 - protein, 329 aa, Oryza sativa
  unsure (1)..(329): unsure at all Xaa locations
MALEAVVYSHGGHFGGYGGGLMGGAPAAPWDVFAAAGGGGSWDDPGLFAAEASLDVIQGVDEWEVDQDQHASSSSKVAARPPVKAAAAAXGKRKRRRAKAAKNREEIESQRMTHIAVERNRRXRMNEYLAVLRSLWQXSYAXRGDQGSLVGGAXNYVGELEQLLQTLEARRTIKDHIDGGAGESPSPFAGFFAFPQYSTATSGHGGGGDAHSRIVVKPAETTTTAAGGGAGAAIADIEASMVEGHASVKVQARRRPRQLLKLVAGLHQLGLTTLHLNVTTVAAMAMYSFSLKVEDGCKLGSVEEIATAVHEILERMQEEQAFADAKTSL

SEQ ID NO: 19421 - protein, 351 aa, Streptomyces coelicolor A3(2)
MTVDGPRSTAPDVVDVVALGESMVTFLPSRPGRLADVPSFDRAIGGAESNVACVLAAAGHSARWAGRVGADGFGDHLVEAIGAYGVDVSAVRRDPARPTGVYFRTAGDRATDAHEVAYYRAGSAASAMSVDTMDLDAIRSGRVLHLSGITPALSAGCLGLMRELTARRPGRPLVSFDVNHRPGLWRDARHGHGPEVLLELARGADLVFVGDDEARDAWGLGGPEAVRAALPEPELLVVKQGASGATAFHGTDATSVPALHVDVVAAVGAGDAFAAGFLSATLRGKPVRERLRHGHLWAAAALTVPADLAAPPARGHADRLVALDDTAWGRLRLGPGWTHAEEGAEEEVRTP

SEQ ID NO: 19422 - protein, 160 aa, Glycine max
  unsure (1)..(160): unsure at all Xaa locations
MNSTEEGMQGIGIGIGSAPSAAVGQLELSPTMSNSSSSLSMELDESPESRIQRLISEHPVIIFTRSSCCMCHVRXKKLLATIGVHPTVIELDDQEIAALPDPGPPAAFIGGTCIGGLESLVGLHVTGHLIPKLVQVGALWYGRIWVSERIWFDSPYTGGR

SEQ ID NO: 19423 - protein, 339 aa, Bifidobacterium longum DJO10A
MLSNPALTVTTLLTLGVIFVNGWTDAPNAIATCVTTRCMRVRSAVIMAAIFNFLGVFIMTQLNASVASTISNMVDFGGDTNAALIALCAALFSIVVYSVGASLLGIPTSESHSLIAGLSGAAIAIQGGIGGINMGEWVKVLYGLVASLLFGFAVGWLVCKAVTLICAGMDRRRTNGFFTYAQIVGAAAMSFMHGAQDGQKFIGVLFLGMAFCNGQPSVTGVMIPIWLMILCSTIMGVGTSVGGERIIKSVGQDMVKLEKYQGFSADLSSALCLLVMTVLGIPVSTTHTKTSAIMGVGAVRRLSAINFGVVRDMMLTWVFTFPGCGLISFVMAKLFMVVF

SEQ ID NO: 19424 - protein, 445 aa, Agrobacterium tumefaciens str. C58 (Cereon)
MRKDWGDGPGGLGTAMQDKILLIEDSVALSMLLRTRLSDETEAEVVHCASMAEADALMQANNFTLALTGLNLPDAPKGEILTLLSERKVPAIVFTATVDEEARKRYAEKKIIDYIVKDGHRTVDAVVKTVDRIMTNKRFSVLVVDDARTARSGLVEILERQNFKVSEAHSGNRALEILSQDPSIQLVITDYHMPDMDGYELTRRIRDSRSSEDLRVIGISSSTDRLLSASFLKAGASDFVYRPFVPEELQCRIDNNIETLKQLKRLRELAERDHLTGLPNRRSFFERTRALMDVINDNDESGAVAILDIDHFKKINDTLGHDAGDRALKKLAELLQGMCDEQRHIPARLGGEEFAVFLRGLDARAAYAFCEELREQVEKNGRQLSGSSLALTISLGVVEIEKGEPFDNQLNAADQLLYLAKANGRNRVYSDIMIQEGLQKIGLNG

SEQ ID NO: 19425 - protein, 89 aa, Zea mays
VTPKTLADVKGGTLISYEGRVQLLEIAQVPDAHVNEFKSIEKFKIFNTNNLWVNLKAIKRLVEADALKMEIIPNPKFVTGINLLNFPGK

SEQ ID NO: 19426 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 19427 - protein, 173 aa, Glycine max
  unsure (1)..(173): unsure at all Xaa locations
MGVQDVLSRKTGVIVGDDVLRLFEYAREKQFAIPAINVTSSSTVIASLEAARDAKAPIILQMSQGGAAYFAGKGVSNTNQAASIAGAVAGAHFIRQIAPTYGIPVVLHTDHCAKKLLPWLDGMLDADEAHFKATGEPLFSSHMIDLSEEEVDWNVKTTAXYLKRAAPMKQWLE

SEQ ID NO: 19428 - protein, 338 aa, Escherichia coli CFT073
MISSGQTGYIPLTSCLKRNTIMTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAVDQEKLEKMIGDLL

SEQ ID NO: 19429 - protein, 185 aa, Glycine max
MISFQCSDKLGLSLELGSFMAGVMISTTDFAQHTLDQVEPIRNLFAALFLSSIGMLIHVHFLWNHVDILLASVILVVVVKTAVAVLVTKAFGYSLKTSFIVGISLAQIGEFAFVLLSRASNLHLVEGKMYLLLLGTTALSLVTTPLLFKLIPAVMNLGVLMHWFPSESSSQIEGKASVIEGNRML

SEQ ID NO: 19430 - protein, 302 aa, Malus xiaojinensis
MSSGTCSTVEPAGAGEIMLFGVRLVVDSMRKSVSLNNLSQYEHPQEAASNNGNNGTAAGKDDAAPGYASENDVVHNSGGNRERERKRGVPWTEEEHKLFLLGLQKAGKGDWRGISRNFVKTRTPTQVASHAQKYYLRRSNLNRRRRRSSLFDITTDTVAPTPMDEEQVQHQDNISQSQLHPLPPPPPSEPRDAGGFSMVPNFARTVGPAVLPVHIENPMENLALRQANPENSTSAKLVHPVALHSAPHATAISDLNLNSTTDASTLTLNLSLSMDSREPSSRHSAFETMQGFSNGDSMISVA

SEQ ID NO: 19431 - protein, 368 aa, Oryza sativa
  unsure (1)..(368): unsure at all Xaa locations
MARRSAPLLQRLLSPTPSPSPSSRRTVTYMPRPGDGAPRAVTLIPGDGIGPLVTGAVRQVMEAMHAPXYFECYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 19432 - protein, 606 aa, Zea mays; identical to SEQ ID NO: 5450

SEQ ID NO: 19433 - protein, 176 aa, Perilla frutescens var. crispa
MAADEEPNTSLNKGAWTADEDGILAQYVAQHGPKRWKSLAIDAGLNRCGKSCRLRWLNYLRPDIKRGNFSDAEDDLILRFHRLLGNRWSLIAKRIPGRTDNEIKNYWNTHLRKKARLMEKLPAISVTAAMELNIWHDESSSSGTEIRDDDESFDFTAQGTSGLDWVKTFLELEEDA

SEQ ID NO: 19434 - protein, 178 aa, Rhodobacter sphaeroides
MTHKSVRDYIRTIVDFPHEGILFRDVTTLFADPRGFRIAIDQLLAPYAGMRFDKVAGLEARGFILGGAVAHRLSTGFVPIRKKGKLPGRTISVSYQLEYGEAVVEVHDDAIQAGEKVLLVDDLLATGGTAEAGIKLIEQLGGQVVGCAFVVDLPDLGGRKRLEAMGMEVHALCAFEGL

SEQ ID NO: 19435 - protein, 426 aa, Thermus aquaticus
MAYQRIQIPQEGEKITIQEGVLKVPDQPIIGFIEGDGTGPDIWRAAQPVLDAAVAKAYGGQRRIVWVELYAGEKANQVYGEPIWLPEETLEFIREYLVAIKGPLTTPVGGGIRSINVALRQELDLYACVRPVRWFQGVPSPVKHPELVNMVIFRENTEDIYAGIEWPAGSEEVKKVLDFLKREFPKAYAKIRFPETSGLGLKPISKEGTERLVEAAIEYAIKEDLPSVTLVHKGNIMKFTEGAFREWGYALAREKYGATPLDGGPWHVLKNPRTGREIVIKDMIADNFLQQILLRPDEYSVIATMNLNGDYISDALAAQVGGIGIAPGANINYKTGHAVFEATHGTAPKYAGQDKVNPSSVILSGEMMLRYLGWNEAADLIIRAMERTISKGLVTYDFHRLLVAEGKPATLLKTSEFGQALIQHMD

SEQ ID NO: 19436 - protein, 151 aa, Picea abies
MAMDPLLSTVQQLLGVPDDLERILHAPTRSYMRDTEATASTPVDVKEYPNSYVFIVDMPGLKSNDIKVQVEDENVLNISGERKRNEKEEGAVKYIRMERRVAKFMRKFTLPADCNLEAISAACQDGVLTVTVPKLPPPEPKKPKTIAVKIG

SEQ ID NO: 19437 - protein, 348 aa, Candida boidinii
MSIPTTQKAVIFYENGGPLEYKDIPVPTPKPNEILINIKYSGVCHTDLHAWKGDWPLATKLPLVGGHEGAGVVVAKGSNVTNFEIGDYAGIKKLNGSCMSCEYCQQGAEPNCPDADLSGYTHDGSFQQYATADAVQAAKIPKDCDLATIAPILCAGVTVYKALKTADLRPGQWVCISGAGGGLGSLAIQYATAMGLRVIAIDGGDEKATFCKSLGAETFVDFTKTKDMVKAIQEATNGGPHGVINVSVSDAAISQSVEYVRPLGKVVLVGLPAHSVVKSPVFEHVVKSIEIRGSYVGNRLDTAEAIDFFSRGLVKATIKIIGLSELPKVYELMEQGAIIGRYVVDTTK

SEQ ID NO: 19438 - protein, 317 aa, Oryza sativa (japonica cultivar-group)
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTGASPREGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKRYRVVDF

SEQ ID NO: 19439 - protein, 207 aa, Triticum aestivum
  unsure (1)..(207): unsure at all Xaa locations
LKLXIQSNIYRYIGILLEGRERFEEEVLADRRKLCQHDPSSSGRPESGFCDEEVTEYSIVPRLKAFSDWILKAMALGNLEDIFPAASREYAPLVEELWKDPAIQATYRRRNELPFLPSAASYFLDRVVDISRTEYELCDIDILYADGITSSDGLASTDISFPQLALDVRXADELDPQDTLLRYQLIRINNKGLRENSKWLQMFDDXS

SEQ ID NO: 19440 - protein, 222 aa, Medicago sativa
HGLALFGTCSTWFLLDIAFYSQNLFQKDIFSAIGWIPPAKEMNAIHEVYKIARAQTLIALCSTVPGYWFTVAFIDYMGRFAIQMMGFFFMTVFMFALAIPYDHWSKKDNRIGFVVMYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELS

SEQ ID NO: 19441 - protein, 191 aa, Zea mays
MGNPEKLMNQIFDLKFTSKSLQRQARKCEKEEKEQKLKVKKAIEKGNMDGARIYAENAIRKRTEHMNYLIGKSMQSIVKSLDSALATGNLQKMSETMDNFERQFVNMEVQAEFMEGAMAGSTSLSTPNTCTTTSPETEVNSLMQQVADDYGLEVSVGLPQAAAHAIPAAKDKEKVDEDDLSRRLAELKARG

SEQ ID NO: 19442 - protein, 364 aa, Escherichia coli
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAACAIERAINRALEEGIRTGDLARGAAAVSTDEMGDIIARYVAEGV

SEQ ID NO: 19443 - protein, 556 aa, Dechloromonas sp. RCB
MTETLTGAQITVRLLERQGIRTVAGIPGGAILPIYDALGQSSAIHHVLARHEQGAGFMAQGMARSTGLPAVCLASSGPGATNLLTAIADAKLDSIPLVAITGQVPKAMIGTDAFQEVDTYGLSIPITKHNFLVSSPEELLAVIPRAFEIATSGRPGPVLVDIPKDVQTQAIEIGEWPEPGRAQPITPTDPALIAQATAMINAAERPILYLGGGVVHSGAARTAVDLAEKSNLPTVMTLMALGTMPVDHPLSLGMLGMHAARYTNLALEECDLLIAVGARFDDRATGKVAAFCPQAKIIHIDIDPAELDKIKTAHLGIAADVQEALTQLLPAVADNDRQVWVDRNNTLKAEFPFEMPGLDNPRSHFGLIRTVAACLDNEATVTTDVGQHQMWVAQAYPLRRPRQWLTSGGLGTMGFGVPAAIGAALAEPQRTVVCFTGDGSILMNIQELVTAAEENVNVKIVLMDNATLGLVHQQQTLFYGERLFASQFKSSPDFIKIAQGFGIAAVDLDLAANPCAALMEAIARPGPCLIHASIDAEQKVYPMVPPGAANRDMIGA

SEQ ID NO: 19444 - protein, 424 aa, Streptomyces coelicolor A3(2)
MQDHLDDVLATVRPLDPIELNLLDAQGCVLVDDITVPLSLPPFDNSSMDGYAVRVTDVAGASEEFPAVLEVVGDVAAGQTDPIAVGPGQAARIMTGAPLPPGAEAVVPVEWTDGGSGEGPVAGMRARSLAPEGAEGHVQVYRPAEERAHVRAKGSDVRSGDRALAAGTVLGPPQIGLLAAIGRGTVRVRPRPRVVVLSTGSELVQPDEQLAPGQIYDSNSFALTAAARDAGAIAYRVGAVADDAETLRATIEDQLVRADLMVTTGGVSVGAYDVVKEALAHVGDEDEPGGGVDFRKLAMQPGKPQGFGSVGPDHTPLLALPGNPVSSYVSFELFVRPAIRTLMGLPDVHRPTVTASLAADKALTSPKGRRQFLRGSHAGGSVTPVGGSGSHLVAALAQANALIVVPEDTESVEPGTEVEVVLLG

SEQ ID NO: 19445 - protein, 514 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 19446 - protein, 195 aa, Buchnera aphidicola
MANILLLDNIDSFTYNLVEQLRNKNNNVLIYRNSVDIKIILNSIKKIKNPILMLSPGPSKPQNAGCMLNLINKIKGEIPIIGICLGHQAIVEAYGGIIGYAGEIFHGKASLINHDGLEMFEGLPQPLPVARYHSLICNKIPKNFIINSYFNDMIMSVRNNLDYVCGFQFHPESILTTSGSLLLEKIINWASLRYK

SEQ ID NO: 19447 - protein, 356 aa, Rosellinia necatrix
MMGACMSSNKEDEEQKKRSQAIDRALDEDSKRLRRECKILLLGSGESGKSTIVKQMKIIHLKGYSEEELYNYRATVFKNLIECAKAVIIAMDQFEIEPSSEGTTDYCDYLRNYTVESGPSARIEAKVGIAVQALWNDPCIDRLMQHATEFYLMDSAGYFFDEVHRICAPDYLPNEMDVLRARTKTTGIYETKFQMGALNIHMFDVGGQRSERKKWIHCFENVTSIIFCVALSEYDQVLLEESSQNRMMESLLLFDSVVNSRWFMRTSIILFLNKVDIFKAKLPRSPLGNYFPDYSGGNDVNKAAKYLLWRFNQVNRAHLNLYPHLTQATDTSNIRLVFAAVKETILNNALKDSGIL

SEQ ID NO: 19448 - protein, 414 aa, Bifidobacterium longum DJO10A
MTKNPKILSIVLAGGEGTRLMPLTRDRAKPAVPFGGVYRLIDFPLSNLVNSGYRQVVVLTQYKSHSLDRHISQVWRFSPLLGSYVSPVPAQQRLGKHWYLGSADAIYQTINIIEDVQPDIVVIVGADHVYRMDFEQMVQQHIESGAEFTVAGIRQPIEESNQFGVIEVDPDHPNMIKNFQEKPPTTTGLPDNPNQILASMGNYVANTKALFEALALDEKAADTKHDMGGDIAPYFASRNEAGVYDFNSNEIPGSTATDHAYWRDVGTIKQFYDAHMDLIAYVPEFNLYNQDWPIYTMSGNLPPAKFVHAGRDRLGHATDSIVSPGVIVSGGEVHHSVLSPNVRIHSWAQIVDSVLFDGVVINRRARVYKAILDKNVVLTENSTVGIDTEHDLARGFTVTPDGITVVPKNTIVDD

SEQ ID NO: 19449 - protein, 425 aa, Oryza sativa (japonica cultivar-group)
MAAASSFTAAAKFLAPVSARSAGDYKPPLPLPASASLRPGRKPAPRLRTALAVSSDVLPGNKAAPAAAAHSAVTREEALELYEDMVLGRIFEDMCAQMYYRGKMFGFVHLYNGQEAVSTGFIKLLNQADCVVSTYRDHVHALSKGVPARSVMAELFGKATGCCRGQGGSMHMFSEPHNLLGGFAFIGEGIPVATGAAFAAKYRHEVLKQSSPDGLDVTLAFFGDGTCNNGQFFECLNMAQLWKLPIVFVVENNLWAIGMSHLRATSDPEIYKKGPAFGMPGVHVDGMDVLKVREVAKEAIERARRGEGPTLVECETYRFRGHSLADPDELRRPDEKSHYAARDPITALKKYIIEQNLATESELKSIEKKIDDVVEEAVEFADASPLPPRSQLLENVFSDPKGFGIGPDGKYRCEDPLFTQGTAQV

SEQ ID NO: 19450 - protein, 207 aa, Staphylococcus epidermidis ATCC 12228
MNQTTIIGIAGGSGSGKTTVTNAIMKNLEGHSVALLAQDYYYKDQSHLTFEERLETNYDHPFAFDNDLLIHNLKDLRNGKPVEVPTYDYSQHTRSKETIAFDPKDVIIVEGIFALENNTLRDMMDVKIYVDTDADLRILRRLTRDTKERGRTMESVINQYLNVVRPMHEQFIEPTKKHADIIIPEGGSNKVAIDIMTTKIQSLVSKK

SEQ ID NO: 19451 - protein, 367 aa, Glycine max
  unsure (1)..(367): unsure at all Xaa locations
QDTPHSPSRFVLQQLFTSIPTASTTELDAVSAFSEIVPDTVVFDDFEKFPPTAATVSSSLLLGICGLPDTIFRNAVEMALADSECYGLENPNARLSCFVNKAFANIGSDMAKLVPGRVSTEVDARLAYDTHAIIRKVHDLLKLYNDSNVPPKRLLFKIPSTWQGIEAARLLESEGIQTHLTFVYSFAQAAAAAQAGASVIQIFVGRIRDWARNHSGDTEIESAQLRGEDPGLALXNRDIHFSDPTYNYIHKYGHKSKLMAAAVRNKQDLFSLLGVDYIIAPLKVLQSLKESIASPDEKYSFVRRLSAQSAAKYTFSDEELVKWDEDSLTKAMGPAAVQLLAAGLDGHADQAKRVEELFEKIWPPPNV

SEQ ID NO: 19452 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMXVDDIPRIVQEAFFLATSGRPGPVLVDVPKDIQQQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKILENRAEELKLDFGVWRSELSEQKQKFPLSFKTFGEAIPPQYAIQVLDELTDGKAIISTGVGXHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 19453 - protein, 416 aa, Staphylococcus aureus subsp. aureus MW2
MNLNDTIFMFLCTLLVWLMTPGLSLFYGGLVQSKNALNTVMQSMAAIVLVTFVWITVGFTISFGNGNLWFGNWEYTFLNHVGFATQEDISPHIPFALFMLFQMMFCTIAISILSGSIAEKMKFIPYLLFVVIWTALVYSPVAHWVWGGGWINKLGVLDFAGGTVVHITSGVSGLVLAIMIGKGNKHSESTPHNLIITLIGGIFVWIGWYGFNVGSAFTFDKIAMLAFTNTVISASAGSIGWLILEYIFKKTTSLLGLLLGALAGLVVITPAAGYVTYLSATIMALIGGICCYIVINYIKVKLKYHDALDAFGIHGVGGIIGAALTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 19454 - protein, 76 aa, Zea mays
NDVIRRDANMSSDTDMSKVFEDRTFVSSILNSFPGVDPNDPSVKDLLASLPSQKEEEKKEDKSDKTEDEKNCFKLE

SEQ ID NO: 19455 - protein, 1305 aa, Neurospora crassa
MATTTALPTLATAVTTAVSTASISGSVLSTISSALASTITTSASLTSSSSSTSSRVLTTTTSVPPKQVPNTDAAGSAQKFGGISLVAFLTALATSLVVFGVQMGLFLLLRHKLARIFKPKTYLVPERERTEPPPASPWNLLSTVLRYNDREIIKKCGLDAYFFLRYLQTLLVLFIPIAIVVIPILIPINYVGGLGHQVVDTNTTDTDDSDVPTGLDTLAWGNVRPEHYRRRWAHLILALLVIIWVCGVFFAELRVYVKIRQDYLTSAEHRLRASANTVLVSSIPDKWLTEDALRGLFDVFPGGIRNVWLTRDFTKLLEKIHRRDAIHVQLEEAETELIREAKRRQLKQRSLEEKRIRKAHQVKAESKKERKHRAKAEDDEAKRRAEDNGGLSVGDDDAVPHDVATAVHGGEKLEGKGLGDIQEGESEGSPHHGPRGGNGLFKVGENLGRGLRKGVGFVEETGHNILVLPKALQHNVEGELERTGGFDFIKDGAQSSPTSSTSSEYDSKLHPGDDDAQPKPSFASETPLQASQARHAHTLSEATQASTVQKGPDTRTIGNTTRKVSNVNDMYVTEKTRWYEFWKPPSGGYVSPVPQGYEREDYPWKVERTKWQKFKAAIPFYHSDIEDVEYPPAFTKDYTTEKEEGAEWQKWLSAKDRPHHRLALFDWTPGWLPALPLLNKKVDTIYWCRAELAKLNLEIEEDQQHPERYPIMNSAFIQFNHQVAAHMACQSVTYHIPKQMAPRTVEISPNDVIWDNMAIKWWHEWARSALVFAVVTGMLVLWAFPVAWTASLAQLDALVEKYSWLHWLVENKTIHNVIKGVAGVLPAAVLAILLILVPIALDWLATFQGAKTGSQTTETVQTYYFAFLFVQVFLVVSITSSTFQTIANITQDITSTPEVLAENLPKAANYFFSYMILQALSTSSGTLLQIGTLFMWYIMARILDNTARAKWTRNTQLPSVTWGSFFPVYTNFACIALIYSVVAPLISIFAIITFALLWCAHRYNMLYVTRFRTDTGGVLYPRAINQTFTGLYVMELCLIGLFFLAVDENDQVACVPQAIIMIIALIFTILYQYLLNRSFGPLLRYLPITFEDEAVIRDEAFQRAQERRLGIIRDDDEATALNRSGPGASDGKDIELRNLHKRTKSEADSLSRLGKLNPVRGIVQAGSWAARGGRQVRQAAFGKAEENLRTATIYRNERRQKDIEAQRAIGDALFGGYHDEIEDLTPEERDVLVRKAFQHYALRARRPTVWIPRDDIGVSDDEIKRTQEFSKYIWISNEGTALDSKVRVVYGRNPPDFSEVDIINL

SEQ ID NO: 19456 - protein, 297 aa, Glycine max
MGQGTPGGMNRQGDRKPDGGDKKEKKFEPSAPPARVGRKQRKQKGPEAAARLPTVTPVTKCKLRLLKLERIKDYLLMEEEFVANQERLKPQEEKAEEDRSKVDDLRGSPMSVGNLEELIDENHAIVSSSVGPEYYVGILSFVDKDQLEPGCAILMHNKVLSVVGLLQDEVDPMVSVMKVEKAPLESYADIGGLDAQIQEIKEAVELPLTHPELYEDIGIKPSKGVILYGEPGTGKTLLAEAVAHSTSPTFWRGGRSELIRQYLGDGPKLVRELFRVADDLSPSIVFIDEIDAVGTKR

SEQ ID NO: 19457 - protein, 497 aa, Staphylococcus aureus subsp. aureus MW2
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 19458 - protein, 181 aa, Arabidopsis thaliana
MASSMLSSAAVVTSPAQATMVAPFTGLKSSAAFPVTRKTNKDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 19459 - protein, 121 aa, Zea mays
  unsure (1)..(121): unsure at all Xaa locations
MAAAAFDAYTDKNAIFRRLKAKPENKMCFDCNAKNPTWASVTYGIFLCLDCSXVHRSLGVHITFVRSTNLDSWTPDQLKMMAFGGNNRAHAFFKQHGWTDGGKVEAKYTSRAAELYRQMLN

SEQ ID NO: 19460 - protein, 160 aa, Oryza sativa
  unsure (1)..(160): unsure at all Xaa locations
MSIAPSSSLRALVAPILPSVSSSPSARPGLRGVAAPVQHARARRRRGAAVVARAAALPSDAEWLERLPEKKKPLYTHSLPCIEAWLRSIGFSQTREDRAVWVAEMPLWHARLSLDLLTPCHIVXIGFAAAGPGNLDKDVERRFSYALSREDIENAILGGP

SEQ ID NO: 19461 - protein, 364 aa, Neurospora crassa
MGYPETFEGFVVDSPKTWNQFHRHELKPKPFGDDDIDVQIECCGVCGSDIHTVTGGWGDFEGPLCVGHEVVGKAIKVGKNVTEIKQGDRVGVGAQVWSCLKCDVCKSKNEQYCPHMVDTYNANYEDGSTAHGGWASHIRAHQYFTFKIPDAIPSHLAAPLLCAGITTYSPLVRANVGPGKTVGIIGVGGLGHLGIQWARALGAEVHVLTHSAYKADDAKALGAQNVIVTSDDEKWAEPYKFKFDFLLNCADATHKFDMKTYLSVLKVGGEFHMCGIPDKPLPPLEVLAFMQNGAKLSANHLGNHQEMKAMLQLAAEKGIVPKVETVQLGEDGCKEAVERVKEGNKVHYRLTLTGFDKVFGKVEY

SEQ ID NO: 19462 - protein, 307 aa, Zea mays
  unsure (1)..(307): unsure at all Xaa locations
MAKSTCKLCSRRFASPRALAGHMRAHSMASAKSQISSASSASTSITASGIDADKKRGPVRGHALRENPKRRGRLDDSDRESETTDYYSPSPDAKRSHAGSGDAEXVSSVSDAATPEEDVALSLMMLSRDSWPAPPPYSYRLDSDDDDESDARPAVVAATAQKRTRYECPACKKVFRSYQALGGHRASNVRGGRGGCCAPPLSTPPPAPLQPLPECEGSEEDSKAQPHECPYCFRVFPSGQALGGHKRSHLCSAAAAAAAAAPVTSGADPSITMRSLGFIDLNLPAPFDDVEVSAMSDPFLSSKPAGS

SEQ ID NO: 19463 - protein, 211 aa, Desulfitobacterium hafniense
FYVGTLFVIMSIYPWNQVGTNGSPFVLTFQHLGITFAASILNFVVLTASLSAINSDVFGVGRMLHGMAEQGSAPKMFAKTSRRGVPWVTVTVMTIALLFAVYLNYIMPENVFLVIASLATFATVWVWIMILLSQIAFRRRLPPEEAKALKFRVPGGVATTVIGLLFLVFIIGLIGYHPDTRISLYVGFAWILLLLIGWQFKTRRERKLAKA

SEQ ID NO: 19464 - protein, 864 aa, GIBBERELLA ZEAE PH-1
MAGQEPDGSEPPSPRTSRRHPPLPRNRSAGELDERTPLLTTSRSHIRISTASSSRQQRGTLSREHSYLGAYHGSRNHSRHPSWSSRLVNALSDRHESSMTESKGTIFPDERMWYDQFTSTDWVHDAIADSHRVKELRSRKDFWGRLRVVFDGAQGWILSALCGFIVALMAYTVDVAESTVFDFKDGHCTRGWYLNRKRCCPDITCDDWETWSYKLNNPFGEVWSSFVIYMAFVLILAAMACWMALWTKTVVPSAYQLTTLDENLAVDNIHHTYDDSNESESSTPQPQAEPKPENPPMVYYSAAGSGVAEVRVILSGFVLHGFLGARTLIVKMVALILSVASGMSLGKEGPYVHMAACVGNILCRIFSKYDRNDGKRREVISAAAAAGVAVAFGAPLGGVLFGLEEVSYFFPAKTLFRTFFCCIVAALSLKFLNPYGTHKIVMFEVRYLVDWEYFELVSFIFVGVIGGALGALFIKASKYWAQSFRKIKLIKKHPLLEVLLVALVTGLMSYWNSLTKLPVAELLLNLASPCEGSNIDWEERALCPGSIDEIPPILSHLFVALLIKGFLTVITFGIKVPAGIYVPSMVVGGLMGRIVGHIVQWAVLRVPHWGIWGDCAFSRDGSCIQPGVYGLIAAGATMCGVTRLSVTLAVILFELTGSLDYVLPFSLAILVAKWTSDAIEPNSIYDLLTSMNSYPFLDNKHKPIFTEDLADIVPRIRKERIIDITNSPVVPATSLRIKLELLHRAGELDGGLPIVRHGILVGLIPAPDLGFALDQLEDEATDLCLMDRVPNIDEDDESHDPTDFTPYIDPAPVALDIKSPMDLVYELFSKLGLRYICVLKDGRYAGMTHKKTFVRYMREHEKHD

SEQ ID NO: 19465 - protein, 198 aa, Triticum aestivum
MSSMQFSSVLPLEGKACVSPVRREGSACERLKVGDSSSIRHDRASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIW

SEQ ID NO: 19466 - protein, 515 aa, Glycine max
MASMAAIGSLNVPRSASSRSSFVGRKSVPRSLSFSASQLCGDKIPTDSVLLAPKIGRSPVIVTPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEARATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETEADKRFLAAKGSVPIGIGRNSHIKRAIIDKNARIGENVKIINSDNVQEAARETDGYFIKSGIVTVIKDALIPSGTVI

SEQ ID NO: 19467 - protein, 188 aa, Triticum aestivum
DEPLLKTHGLPVLVRLDEAYVALPSLQSRMTCVKKHDNWIDLQTFSKRAGLAGLRVGYGAFPLGIIEYLWRAKQPYNVSVAAEVSACAALQNPVYLESVKNLLLQERERLYNLLKGIPYLKPFPSHANFILCEVTSGKDAKKIKEDLAKMGVMIRHYDKKELKGYIRISVGKPEHTDALMEGFKALKL

SEQ ID NO: 19468 - protein, 232 aa, Lilium longiflorum
MGRGKIEIKRIENTTNRQVTFCKRRNGLLKKAYELSVLCDAEVALIVFSSRGRVYEYSNNSIKQTIDRYKKACDSSNSNSLIQVNSQQYFQQESAKLRHQIQILTNANRHLVGEALSSLTVKELKQLENRLERGLTRIRSKKHELLFAEIEFSQKREVELQSDNMYLRAKIAENERTQAAIVQARAEFDALPTFDSRNFYQVNNMLEAPPHYHHQDQTALHLGYEAKDDSVP

SEQ ID NO: 19469 - protein, 344 aa, Nitrobacter sp.
IGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLINAPLADEQPTARAISMVTGKYMDTIEAGPNWDDDLGGSQVYANNDPNFDGASDEEMRQINEVNSTVFFYLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPSAKITAAQQSPVYQFVKKWGIALPLHPEFRTLPMLFYVP

SEQ ID NO: 19470 - protein, 521 aa, Glomus versiforme
MSTSDRVTIDVDKRRAALKEIDDAKFGWQHIRACLVAGTGFFMDAYDLFAVNFASTMIGYVYYGGKTPANIDLGLKVTGSIGTLLGQLFFGYLADRLGRKRMYGVELMIIIVATVASALSGESRAVTVVGTIMFWRVIMGVGIGGDYPLSAIITSEFATKKRRGAMMASVFAMQGFGILGSAIVALAVLAGFRNEIIKDVSAVDYCWRIVLGCGAVPGLAALYFRLTIPETPRYTMDVEHDVNKATSDITSYLQKNDVNEDDTNTGNHVGVPKASWSDFVSYFGKWSNGKVLLGTSMSWFALDIAFYGIGLNNGIILSAIGYSETHEADLNLRAYNSLKNMAVGNIIITIMGTAPGYWVTAALVDSWGRKPIQLMGFGVLTALFIVMGAAFNPLKEHSIPAFIILFTLLQFFQNFGPNTTTFIVPGEVFPTRYRSTGHGISAASGKLGAIVAQVGFSKLKDIGGSNAFVGPLLLIFSAWMFIGGLFSILIPETKGLSLEELANEEHTYDVEERKERIKADA

SEQ ID NO: 19471 - protein, 403 aa, Triticum aestivum
MDAGGAQPPDSEMAEAGAGAAAAAGTAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMEVFPCGISSLQLIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 19472 - protein, 364 aa, Nicotiana tabacum
MGSTSESQSNSLTHTEDEAFLFAMQLCSASVLPMVLKSAVELDLLELMAKAGPGAAISPSELAAQLSTQNPEAPVMLDRMLRLLASYSVLNCTLRTLPDSSVERLYSLAPVCKYLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKYPSIKGINFDLPHVIGDAPTYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTSN

SEQ ID NO: 19473 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 19474 - protein, 89 aa, Glycine max
  unsure (1)..(89): unsure at all Xaa locations
TMIAAPAVTTVHHAGAGMAAPFTGQKSMVGFPTRKTNNGISCIGYNCLRLQCLQVWTPVVKSEVETLSYLPHLVDAQMAKEVXYLIRNG

SEQ ID NO: 19475 - protein, 270 aa, Diospyros kaki
NWGLFELVNHGIPPELMDTVERLTKEHYKKCMEQRFKELVASKALEGVQAEVTDMDWESTYFLRHLPQSNISELPDLDEEYRRVMKDFAERLEKLAEYLLDLLCENLGLEKGYLKKAFYGTKGPNFGTKVANYPPCPKADLIKGLRAHTDAGGIILLFQDDKVSGLQLLKDDQWIDVPPMKHSIVINLGDQLEVITNGKYKSVLHRVVAQTDGTRMSIASFYNPGNDAVIYPAPALVEKEIQEKEIYPKFVFDDYMKLYAALKFQAKEPR

SEQ ID NO: 19476 - protein, 195 aa, Morus alba
GFFEVTHDISNLTCADFLRAPGVQTPVIVRFSTVIHERGSPETLRDPRGFAVKFYTREGNFDLVGNNFPVFFIRDGIKFPDMVHALKPNPKSHIQEFWRILDFFSHHPESLHMFTFLFDDIGVPQDYRHMDGSGVNTYTLIDKAGKAHYVKFHWKPTCGVKSLLEDEAIRVGGANHSHATQDLYDSIAAGNYPEW

SEQ ID NO: 19477 - protein, 290 aa, Oryza sativa (japonica cultivar-group)
MAKHLALSVAAAVAVSWLAASSAAAAGFYEKFDVVGAGDHVRVVSDDGKTQQVALTLDRSSGSGFTSKDTYLFGEFSVQMKLVGGNSAGTVTSFYLSSGEGDGHDEIDIEFMGNLSGNPYVMNTNVWANGDGKKEHQFYLWFDPTADFHTYKIIWNPQNIIFQVDDVPVRTFKKYDDLAYPQSKPMRLHATLWDGSYWATRHGDVKIDWSGAPFVVSYRGYSTNACVNNNPAGGWSSSWCPEGTSAWIHRELDGAELGTVAWAERNYMSYNYCADGWRFPQGFPAECYRK

SEQ ID NO: 19478 - protein, 390 aa, Pseudomonas putida
  unsure (1)..(390): unsure at all Xaa locations
QATVVFLLAVVLLVPLAQRLKMGAVPGYLLAGILIGPSVFGLLGNPDNVARLSEMGVVMLLFVIGLELSPKRLWTMRRALFGVGSLQVGLTAVLLGLLAFWLFDQSKPAAIVLGLGLALSSTAFGLQVLAERKDLGKPHGRMAVAILLFQDIAAIPLIAVVPLLGGDVSTADEGAWPLLAVVVGIGVLIVFGRYLLTPIFKWTVGSGLPELSTATALLVVLGTAWLMEHVGVSMALGAFLAGVLMAESPFRHELETQIEPIKGLFLGLFFVGVGMSADLRLLFGMPLMVLGLTLLLVAIKLPLLYGLGRTMGGLNKSQALCLGVVLASGGEFXFVVFKLALEHQVLTQAVHDLLVLAITLSMAVVPLVMMALARQLHDDSPVQASPETGQ

SEQ ID NO: 19479 - protein, 136 aa, Zea mays
  unsure (1)..(136): unsure at all Xaa locations
CAVAAPCARPHQGLGLVKPMXEMLMAANAGAANPSQSSNPNPPAPAPSLAPGGLLGGXAPXAXAGAGSTERRARPQKEKALNCPRCNSTNTKFCYYNNYSLQQPRYFCKTCRRYWTEGGSXRNVPXGGGSRKNKRS

SEQ ID NO: 19480 - protein, 492 aa, Candida albicans
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDNDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKNEEVFSPLVKNYAYFTDGSYTPEEVVQAEKYMLTILNFDLNYPNPMNFLRRISKADDYDVQSRTLGKYLLEITIVDYKFIGMRPSLCCALAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 19481 - protein, 200 aa, Solanum tuberosum
MADQGLEGSQPVDLTKHPSGIVPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYAHGAFSSYEPELFPGLIYRMKQPKIVLLIFVSGKIVITGAKVRDETYTAFENIYPVLTEFRKNQQ

SEQ ID NO: 19482 - protein, 328 aa, Triticum aestivum
MIDLEISQILLCPMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 19483 - protein, 585 aa, Lactobacillus plantarum
TNILAGAAVIKVLEAWGVDHLYGIPGGSINSIMDALSAERDRIHYIQVRHEEVGAMAAAADAKLTGKIGVCFGSAGPGGTHLMNGLYDAREDHVPVLALIGQFGTTGMNMDTFQEMNENPIYADVADYNVTAVNAATLPHVIDEAIRRAYAHQGVAVVQIPVDLPWQQIPAEDWYASANSYQTPLLPEPDVQAVTRLTQTLLAAERPLIYYGIGARKAGKELEQLSKTLKIPLMSTYPAKGIVADRYPAYLGSANRVAQKPANEALAQADVVLFVGNNYPFAEVSKAFKNTRYFLQIDIDPAKLGKRHKTDIAVLADAQKTLAAILAQVSERESTPWWQANLANVKNWRAYLASLEDKQEGPLQAYQVLRAVNKIAEPDAIYSIDVGDINLNANRHLKLTPSNRHITSNLFATMGVGIPGAIAAKLNYPERQVFNLAGDGGASMTMQDLATQVQYHLPVINVVFTNCQYGFIKDEQEDTNQNDFIGVEFNDIDFSKIADGVHMQAFRVNKIEQLPDVFEQAKAIAQHEPVLIDAVITGDRPLPAEKLRLDSAMSSAADIEAFKQRYEAQDLQPLSTYLKQFGLDD

SEQ ID NO: 19484 - protein, 226 aa, Paeonia suffruticosa
SQVTFSKRRGGLLKKAHEISVLCDAEVALIVFSTKGKLFEYSTDSSMEKILDRYEQYSIAERQLVEEPGSQGNWSLEYSKLRAKIELLQRNQRRFMGEDLDSLSPKDLQNMEQQLDVSLKNIRSRKNQLMYESISELQKKERAIQEQNNLLAKQIKEKEKTMAQQAQWEQQIHHGPNASAYLLSPHELTTLNMGGNYQGEPTEMRRNELDLTLEPIYTCHLGCFGA

SEQ ID NO: 19485 - protein, 245 aa, Lycopersicon esculentum
MATNSSSHSPRTVEEIFKDFSARHAAVLRALTTDVEDFYSQCDPERDNLCLYGHPNESWEVAVPAEEVPPELPEPVLGINFARDGMERRDWLSLVAMHTDSWLLSVAFYFGARLNRNERSRVFTLINDLPTVFEAVTGRKPLKDKPSVDSGKKSKNNAKREKQMKANQRLQEESDDEDEGNEDEHEETLCGSCGTNGNEDEFWIGCDMCEKWYHGKCVKITPAKAQSIKEYRCPSCSNKRAKHMA

SEQ ID NO: 19486 - protein, 296 aa, Shewanella oneidensis MR-1
MQDRFIRSITQLPTPLADALIPLLHQGFAGHIDAQHLAELVKSSNMTESEVLLALLPIAAALAKPPISEFYVGAIAKGKSGDIYMGANLELPGEALFHSVHAEQSAISHAWLSGESQIVDMIVNASPCGHCRQFMNELVDGGQIKIHLPSQDSHLLSYYLPYAFGPKDLNVQSPLLVKQETEFALDSSDPMVIEALDHAGLSYAPYTQSYAAVVLETADGATYCGRYAENAAFNPSMLPMQMALSNLTRHNRDFAEIRRAVLVESSQGKISLVGAAMDALHAVAAIELEHIVVDPI

SEQ ID NO: 19487 - protein, 130 aa, Oryza sativa (japonica cultivar-group)
MYGWSGIPAAVKVEKENEWKTPATWEWKAPATRVAGEYVTLKVQGTDGRAVYRTMLRTEELQGLMDFYYDRSHGRVQRGTGRFLFDGRRLRGWQTPAELQMEDGDEVNFFEELIGGAAGSGWDPPSSILA

SEQ ID NO: 19488 - protein, 213 aa, Triticum monococcum
MSMSCGLCGANNCPRLMVSPIHHHHHHHQEHQLCEYQFFAHGNHHHHHHGSAADYPVPPPPDNFDHRRTWTRPFHETAAAGNSSRLTLEVGAGGQHMAHLVQPPARAHIVPFYGGAFTNTISNEAIMTIDTEMMVGPAHYPTMQERAAKVMRYREKRKRRRYDKQIRYESRKAYAELRPRVNGRFVKVPEAMASPSSPASPYDPSKLHLGWFR

SEQ ID NO: 19489 - protein, 438 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEAEFFIFDDVRYSVTPAKVAYQIDAEAAAWNTDAEVEMGNLAHRAGHKGGYFPVNPVDEAQDLRGEMLSTMKRMGMKVDKHHHEVATCQHELGLIFGGLTEQADNILKYKYVIHNVAHAYGKTVTFMPKPMKGDNGSGMHVNMSIWKDGKPLFAGDKYADLSQEALYFIGGILKHAKALNALTNPGTNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALTELEKDHDFLLAGDVFTKDQ

SEQ ID NO: 19490 - protein, 159 aa, Frankia sp. FE131
ITKEQYSRDPRNIAKKAETYLRGTGIADTAFFGPEAEFYIFDDVRYDYNPYGSFHQVDSVEAAWNTARKEEGGNLGYKPRFKGGYFPVPPTDHFTDLRSEMTRVLYETGITVEMQHHEVGTAGQAEIDIRYDTLLKTADNLMLYKYVIRNVARSRGKTV

SEQ ID NO: 19491 - protein, 461 aa, Mazzaella linearis
  unsure (1)..(461): unsure at all Xaa locations
WDPDNIVKDTDVLALFRVSPQPGVDPVEASAAVAGESSTATWTVVWTDLLTACDLYRAKAYKVDTVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLNFLKDDENINSQPFMRWKERFLYSMEGVXXXXXXXXXXXXXXXXXXXXXXXXXXXXXRFAKQLGSIIVMIDLVIGYTAIQSMAIWARTNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGXTANRVXLESMVITRNEXRDYVSXGTQILQDAAKTCGTLQTALDXWKXXNFNYTSTDTXEFVKTXXXNFK

SEQ ID NO: 19492 - protein, 369 aa, Oryza sativa (japonica cultivar-group)
MVMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 19493 - protein, 351 aa, Zea mays
  unsure (1)..(351): unsure at all Xaa locations
MAYARTVMAAAASALLMAVGVRFLGPAAAAFVEEELPRARAVAATWLTPPYLYLVINAIIISIAASSRFQSSGGAGGRPSAPSYAPAADPDADAIGGEGAGEEIAAAGWXQPAVASLQVPAAVPVVAAKAAEVAAVVEEPVVVEIHTVAVAPEGEVDEDYSVSRSTWTPRRRGAEPEVAAEVPPFADLTNSRKKPLVSARFSRKATKPSPEGSRALRVARPRKEETLESTWKAITEGRGPTLARHLKKSDTWDTRSPGXRPSGGGSSGEVDPAAVAPAGTMRKAETFNDGGAGRSRPAPAALVRREPSLGQDELNRRVEAFIHKFNMEMRLQRQESLKHYNDMIGRGRGSR

SEQ ID NO: 19494 - protein, 298 aa, Thermobifida fusca
MTRVVVVGDLMTDSIARAFYPLARGSDTPASVATFGGGSGANVAAWLAVEGTDTALIGRRGSDITGRTREMELMGYGIDARMVMDPERPTGTCVVMITHRGDRTMLSDPGANAALQPEDLPRDLFGPDGHLHLSGYTLLNEGSRRAGRVALRLAQESGMSISVDCGSHAPLERVGAEAFLEWTNGVRLLFANQEQAAVLTGRDDPDAAAKVLTAWYPNIVIKLGADGALWASKAREGTLHVPAEPVEPVPGAIGAGDAFIAGFLPAWLAGKHPKEALISAQRLAARALLQPGARPELD

SEQ ID NO: 19495 - protein, 661 aa, Oryza sativa
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDAADAVVQVEDTEHLPGAPDGSKMVRISSPTTQTQDIRNVRLIIGRSTRAMSLTLKLRLWTSGIGVSEPRPTAREARARHNRVRSKFDPRGLPAFTSSTCEFIRYPSRVQLTALFFQHQCKVDTRGITKVTEESFDVHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 19496 - protein, 231 aa, Triticum aestivum
  unsure (1)..(231): unsure at all Xaa locations
MDHAADAQRTDLMTITRHALNEQGRHPESRGDFTILLSHIVLGCKFVASAVNKAGLAKLIGLAGETNVQCVLVSEENEAAIFVDAPLRGKYCVCFDPLDGSSNIDCGVSIGTIFGIYMIKDKDNATLEDVLQPGTDMIAAGYRMYRSSCTLVLSTGNGVNGFTLDPSLGEFILTHPNIKIPNKGKIYSVNEGNARNWDAPTANQHXYVERCKFPQDGSSPKSLRYIGSLVA

SEQ ID NO: 19497 - protein, 355 aa, Burkholderia fungorum
MTRSDFEEFAMAFIALRQLLDHAAEHGYGVPAFNVNNMEQIHAIMQAAEATSSPVILQASAGARKYAGEPYLRHLVLAALEAHPDIPLVLHQDHGASPAVCQQAIRSGFTSVMMDGSLLPDQKTPAAYEYNVDVSRRVVEAAHAVGVSVEGELGCLGSLETGTAGDEDGVGAEGQLSRDDLLTDPREAQIFVEATGVDALAIAIGTSHGAYKFSRQPTGDILAIDRIVEIHERIPNTHLVMHGSSSVPQEWLAVIREYGGEIPTTYGVPVEEIQRGIAHGVRKVNIDTDIRLAMSGAMRKSMANARAEFDPRAALKAATAAASAICVERFEAFGCAGQASRIKPLPLDAMARRYH

SEQ ID NO: 19498 - protein, 332 aa, Phaseolus coccineus
MVVLSQPALNQFFLLKPFKSTPLFTGIPVVDLTHPDAKNLIVNACRDFGFFKLVNHGVPLELMANLENEALRFFKKSQSEKDRAGPPDPFGYGSKRIGPNGDVGWVEYLLLNTNPDVISPKSLCIFRENPHHFRAVVENYITAVKNMCYAVLELMAEGLGIRQRNTLSRLLKDEKSDSCFRLNHYPPCPEVQALNRNLVGFGEHTDPQIISVLRSNSTSGLQICLTDGTWVSVPPDQTSFFINVGDALQVMTNGRFKSVKHRVLADTTKSRLSMIYFGGPALSENIAPLPSVMLKGEECLYKEFTWCEYKKAAYTSRLADNRLAPFQKSAAD

SEQ ID NO: 19499 - protein, 118 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGI

SEQ ID NO: 19500 - protein, 83 aa, Oryza sativa
  unsure (1)..(83): unsure at all Xaa locations
PGNLQKMSGALGNFEXQFVNMGGPAEFLGGAMGGSPSLSRAGAGGTPLFQQVPGEXGLGVSVGLPQAPAPAIPIAKEKEKAFF

SEQ ID NO: 19501 - protein, 396 aa, Triticum aestivum; identical to SEQ ID NO: 3139

SEQ ID NO: 19502 - protein, 339 aa, Mycobacterium tuberculosis H37Rv
MELSPDRIMAIGGGYGPSKVLLTAVGLGLFTELGDEAMTAEAIADRLGLLKRPAIDFLDALVSLDLLARDGDGPGSHYRNTPETAHFLDEARPTYAGGLLKIWNERNYRFWADLTEALKTGKAQSEVKQTGRPFFEALYADPRRLEAFMAAMDAASRRNIELLAKRFPFERYRRLCDVGCADGLLSRIVAAAHPHLQCVSFDLPAVTEIARRKLTAEGLGERVQACAGDFLADPLPAADVITMGQILHDWNLDRKQQLVAKAYEALSKEGAFIVIETLIDDARRENTTGLMMSLNMLIEFGDAFDYSAADFRGWCGEAGFRSFEVIPLAGGSSAAVAYK

SEQ ID NO: 19503 - protein, 511 aa, Lycianthes rantonnei
MVLLLISELCASAIIFIIVHIIISKLIATGWGRRQRLPPGPMGWPVIGALPLLGTMPHVALAKMAKKYGPIMYLKVGTCGMVVASTPNAAKAFLKTLDINFSNRPPNAGATHLAYDAQDMVFAHYGPRWKLLRKLSNLHMLGGKALEDWANVRANELGHMLKSMFDASRVGGRVVVADMLTFAMANMIGQVILSKRVFVEKGAEVNKFKDMVVELMTVAGYFNIGDFIPQLAWMDLQGIEKGMKCLHKKFDDLLTKMFDEHKATTNERKGKPDFLDVVMANRDNSEGERLSTNNIKALLLNLFTAGTDTSSSAIEWALAEMMKNPQILKKVQQEMDQIIGKNRRLIESDIPNLPYLRAVCKETFRKHPSTPLNLPRISNEPCMVDGYYIPKNIRLSVNIWAIGRDPDVWENPLEFNPERFLSGKNVKIDPRGNDFELIPFGAGRRICAGTRMGIVMVEYILGTLVHSFDWKFSNDVKEINMEESFGLALQKAVPLEAMVTPRLPFDVYYTN

SEQ ID NO: 19504 - protein, 832 aa, Rhodobacter sphaeroides
MNIVLLVTALAVLFIVIAACEPVAARLRLPYSVVLAVVGAMLGTLALWLQRSGVAASFPPEVADLLALPIRSSVFLYIFLPTLLFQVSLSLNIRRMIDDWVPILVMAVVAVLVSTLAIGFALQPFSSMSLAACLLLGSIVSTTDPSAVVSIFRSIAAPQRLTRIVEGESLLNDAAAIALFGFFLTFVMAGVPDPTLRQALVEFPLLILGGLGLGYLMARIALFLMTRMASHPTAQLSLSLALPYLTYVLAEQGFHASGVIAVVTAGIAMNLTGPGRLSPATWKLLSDIWEMLSHWAGSLIFIVAALLIPRLIGRATGWDLLLIGVVALAAVVARGVMLSGLLPLLTRFNLSPRVERPYRVAILWGGLRGAVTLALALAVTENPMVPPHVKREVGILATGFVLFTLLAQGTTLRWVIRRLGLARLTPLDLALSNQVIAVALQNVREGVAETVRERELDPQIVRSEAKGFGQRLARAVELADDSADDIPDRDRITLGLVALAGRERDAILAAFRQQIISPRLAEAMLVDVDRLIERTRLQGRDGYRAAGRRALGLGRQHRIAVWAHNRLKITRWLSQLTSDRFEMLLTQRLILGDLHGLIDGKIRRIHGRRVAEILHEMLKRREEETEQALEALRLQYPGYSEEMVRSFIRRTALQLELREYEMLHDDGLIGQELFMTLRQRIQVARGKKERRPHLDLAVQKVELVRQFPLFAEMEEDQLRALERLLQTVYVRPGDVLLRRGDVPRKVFFIASGAVESDVAGQKVRLGRGEMFGQLAILTRKTRKAQVTAISHGTLLSLDEARFLELLRRNRTLQEAAVESAARRNVTIDLSAI

SEQ ID NO: 19505 - protein, 121 aa, Glycine max
SSQLRRPPPPSFMNEHWSEAAFCAGFESAQQHFVNFMRIMERGESPIRLGDLPLELVIAMAYLPLYKECMNSNGRLLPQRLRGQLVEAASRLEDRQVERDSQSRELLAILEHHIPRFMMQT

SEQ ID NO: 19506 - protein, 391 aa, Oryza sativa (indica cultivar-group)
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPTPFNPGMSATDLLAYERTLALSKMAANPALMSQHAALKQAAAMGMGAGASQAIYDGGYQSANAVFY

SEQ ID NO: 19507 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGIAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 19508 - protein, 678 aa, Burkholderia fungorum
MNDLSQTQPRDAVLPEAAGAVPPASAPAPAAASEAPAASLDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 19509 - protein, 408 aa, Shewanella oneidensis MR-1
MTVSELRFALDTFYFLISGALVMWMAAGFAMLEAGLVRSKNTTEILTKNVVLYAIACVMYLLVGYNIMYVDNAEGGWLPSFGTLIGSQAADANHALESDFFFQVVFVATAMSIVSGAVAERMKLWAFLVFSVVMTGIIYPVEGYWTWGKGFIASLGFVDFAGSGIVHMTGAAAAIAGVLLLGARKGKYGPNGQVNPIPGSNLPMATLGMFILWMGWFGFNGGSQLMVSDAANASAVAKVFVNTNTAAALGAISALIVCKMIWGKADLTMILNGILAGLVAITADPLSPSLLMAGVIGLVAGGLVVFSIVGLDRIKIDDPVGAISVHGVAGFLGLMCVPLSNANATITAQLTGAAIIFAWVFSASFAVWFVLKMTMGIRVSEEEEYNGMDASDCGIDAYPEFVTVKSAG

SEQ ID NO: 19510 - protein, 446 aa, Triticum aestivum
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 19511 - protein, 362 aa, Thermobifida fusca
MAQTRTRRLRNVRKSGQNRIYHRWGVCGRAPSTSHTPPNKIHFAFKREVVSIENLESTAVTNTAENTTESTVGTVRVKRGMAEQLKGGVIMDVVTPEQAKIAEDAGAVAVMALERVPADIRKDGGVARMSDPEMIEGIINAVSIPVMAKVRIGHFVEAQVLQALEVDFIDESEVLTPADETNHINKWDFTVPFVCGATNLGEALRRIAEGAALIRSKGEAGTGNVVEAVRHMRQITSEIRRLTQLDDAELFAAAKELRAPYELVREVAREGKLPVPLFSAGGVATPADAALMRQLGAESVFVGSGIFKSGDPAKRAKAIVEATTAYDDPHTIARVSRGLGEAMVGINLDELDASQRYAGRGW

SEQ ID NO: 19512 - protein, 543 aa, Glycine max
MVESQPKFFIPDSINGVNFDVAAQIKMVWEVMKAPLIVPLLNLAVYISLAMALMLFMERVYMGIVIILVKLFWKKPHQRYKFEPLQDDEELGNSNYPVVLVQIPMFNEKEVYKVSIGAACNLSWPADRLVIQVLDDSTDPTVKQMVEMECQRWASKGINIVYQIRETRGGYKAGALKEGLKRNYVKHCEYVAIFDADFRPEPDFLRRSIPFLVGNPDIALVQARWRFVNSDECLLTRMQEMSLDYHFTVEQEVGSATHAFFGFNGTAGIWRIAAINEAGGWKDRTTVEDMDLAVRASLRGWKFLYLGDLQAKSELPSTLRAFRFQQHRWSCGPANLFRKMVMEIVRNKKVRFWKKVYVIYSFFFVRKIIAHMVTFFFYCVVIPLTILVPEVHVPIWGAVYIPSVITILNSVGTPRSIHLLFYWILFENVMSLHRTKATFIGLLEYGRANEWVVTEKLGDSVNNNNKNKSGDAAKKNNAIKATPKKTRSKFVERLNLLELGFAVFLFVCGCYDYVHGKHNYFIYLFLQTLTFSIVGFGYVGTIV

SEQ ID NO: 19513 - protein, 341 aa, Staphylococcus aureus
MSTNIAINGMGRIGRMVLRIALQNKNLNVVAINASYPPETIAHLINYDTTHGKYNLKVEPIENGLQVGDHKIKLVADRNPESLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSAMVMSGNKVKVIAWYDNEWGYSNRVVDVAEQIGALLTSKETVSAS

SEQ ID NO: 19514 - protein, 507 aa, Oryza sativa
  unsure (1)..(507): unsure at all Xaa locations
SSRSLGVFVVNASGEGKSRRLTAQAPSQRPPPVVVLLLVSPRGDGNKRIKQEVPDKDAFRRVIKGPPFSAPRHLLLCSPLLLLLQSKLRSSSSKQPNAAHTKLCSSCSSYTRAAAHSVELRAQRGALGRHKFRLSDMIPNAWFFKLRDMRAARGGAGAGGGGASHGGVVTQSSVAVSRAXGRACRPLPNTPRHGALSLPHRASYYYTPRAGDLLVGSPLHPKCSDTQFPPLQLSPPRKSRRRHRRRSVKLAPSVSGSSVLSSPVSTGCXRCGRKPELVVVEAPENPPCRRDKFVGYNDDDDYEEEEEVEFKKPTVAVAACDELDGKVITSATDIIIDLRTEKRPDKVLPPIVTKPARRELDGCDLEEKHIDVVRRASAKKPTTLLEQSKPRRSVSSARRLKTRANTPRIVAKKSKPPPPPPPAAARSPAPTTKPPLAESFAVVKSSRDPRRDFRESMEEMIAENGIRTAADLEDLLACYLSLNAAEYHDLIVDVFEHIWANLADIKM

SEQ ID NO: 19515 - protein, 386 aa, Zea mays
MGHQQAQHGKDDTEELLAAHRQLWCHALGYVKSMALKCALDLRIPDTIDRCGGSATLGELLAASEIPASNHDYLRRVMRTLTAMRIFAASHDPAKADDAAAISYQLTPASRLLVSSSSSVDDAAGASKENTTTPSILPNIAHLVRPNTISLLFSMGEWMKDESAASVSLYETVHRQGMWACVEDDAANRASFYESMDADTRLVMQAVVRRCPHVFDGIKSLVDVGGGRGTAAAAIVAAFPHIQRCTVMDLPHVVAEAPAGTAGLSFHGGDMFEHIPSADALMLKWILHDWDEDKCIKIMERCKEAIGGKEAGGKVIIIDTVLGSRADDDDDKTCRETYVLDLHILSFVNGAEREEHEWRRIFLAAGFRDYKITHTRGIPSIIEVFP

SEQ ID NO: 19516 - protein, 428 aa, Escherichia coli CFT073
MKIATIKTGLTSLAMLPGLVMAAPAVADKADNAFMMICTALVLFMTVPGIALFYGGLIRGKNVLSMLTQVTVTFALVCILWVVYGYSLAFGEGNNFFGNINGLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 19517 - protein, 564 aa, Pseudomonas aeruginosa UCBPP-PA14
MTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGISPAYTLPVVLDVGTNNPDLLNDPMYMGWRHERVSGAQYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTRGEGAVLPALGDIREVSKRIAVAVAKQAQAEGKALHTSDEVLNDAIEANFWFPRYRAYRRTSF

SEQ ID NO: 19518 - protein, 419 aa, Grateloupia acuminata
DTDVLALFRVTPQPGVDPIEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGDDVVLQFGGGTIGHPDGIQAGATANRVALESIVIARNEGRDFGAEGPQILQDAAKTW

SEQ ID NO: 19519 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELDSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 19520 - protein, 89 aa, Zea mays
MAGTIQSVMARQIFDSRGNPTVDVDEYCSDGTFARAAAPTGALTGVYEALELRDGGSDYQGKGLYNAVNNVNGDIGPVLIDKDPTAHTE

SEQ ID NO: 19521 - protein, 469 aa, Nannochloropsis salina
ISVSYAEMGYWDANYTIKDTDVLALFRITPQPGVDPIEAAAAIAGESSTATWTVVWTDLLTACDVYRAKAYKVDSVPGTSDQFFGYVAYECDLFEEGSIANLTASIIGNVFGFKAVKALRLEDMRMPYAYLKTFQGPATGVIVERERLDKFGRPLLGATVKPKLGLSGKNYGRVVYEGLKGGLDFLKDDENINSQPFMRWRERFSYVMEGVNRSAAASGEVKGSYLNVTAATMEEMYERAEFAKLIGSVIIMIDLVIGYTAIQSMAIWSRKNDMILHLHRAGNSAYARQKNHGINFRVICKWMRMAGVDHIHAGTVVGKLEGDPLMVKGFYNTLLQTSLDINLPQGIFFEQDWASLRKTLPVASGGIHCGQMHQLLNYLGEDCVLQFGGGTIGHPDGIASGATANRVAMECVLLAKYEGKDYINEGPKILRAAAESCAPLRTALDLWKDIAFNYTSTDTADYVETTTKQ

SEQ ID NO: 19522 - protein, 318 aa, Microbulbifer degradans 2-40
MSSNQLDQLKALTTVVVDSGDINAVARYQPEDATTNPSLVLKAIEQPEYNHLVAQAVAWAKEFAKDKPLVTATADKLAVMLGCEILKHIPGRVSTEVDAHLSFNTEATIAKALELVAMYEQAGVDKSRILIKIASTWEGIQAAKQLEKMGIQCNLTLLFGFAQAQACAEAGVFLISPFVGRILDWYKKDQPNADFTGLNDPGVVSVTKIYNFYKACGFQTVVMGASFRNVGELQSLAGCDRLTISPALLDELQNQTAPLVALLVDKGVSEEKPAPLTEGSFRWAMNEDPMATEKLAEGIRNFAKDQVKLYRLIEKVAG

SEQ ID NO: 19523 - protein, 679 aa, Glycine max
VYYGAGGTFALYSLLCRHANIKTIPNQHRTDEELTTYSRSTFHEKSFAAKTKRWLEEQESAKRAILILVLVGTCMVIGDGILTPAISVLSAVGGIKVNQPRMSSGVVVLVAVVILVGFFSMQHYGTDRVSWLFAPIVLLWFLLIGGIGIFNICKYGSSVLKAFSPLYIYRYLQREGKEGWTSLGGIMLSITGTEALFADLAHFPVSSVQIAFTLLVFPCLLLAYSGQAAYLMHNLDHSKDAFYRSIPDKIYWPVFVVATLAAIVASQATISATFSIIKQALAHGCFPRIKVVYTSKKFLGQIYIPDINWILMILCIAVTAGFKNQNQIGNAYGTAVVIVMLVTTLLMILIMILVWRCHWILVLVFTGLSLIVECTYFSAVLFKVDQGGWAPLAIAGAFLLIMYVWHYGSVKRYEFEMHSKVSMAWILGLGPSLGLVRVPGIGLVYTELASGVPHIFSHFITNLPAIHSVVVFVCVKYLPVYTVPEDERFLVKRIGPKNFHMFRCVARYGYKDLHKKDEDFEKKLFHNLFVFVKLESMMEGCSDSDDYSLYDEQTERSTQGLLNNNTNTAALNMDPTVSSVDSIVSVSSPLHINATIQSSGHVSSHTEVDEVEFLNNCRDAGVVHILGNTVVRARRDSRFHKKIAVDYIYAFLRKICRENSVIFNVPHESLLNVGQVFYV

SEQ ID NO: 19524 - protein, 425 aa, Helicobacter pylori 26695
MAYNPKILQKPKEGEEITIKDNKLHVPNHPIIPFIEGDGIGSDITPAMIKVVDSAVQKAYKGEKKIAWYEVFVGEKCYQKFKDYKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVKKIRFPESSGIGVKPISKEGTERLVRKAIEYAIDNDKPSVTFVHKGNIMKYTEGAFMKWGYALAQKEFNAQVIDKGPWCSLKNPKNGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 19525 - protein, 428 aa, Neisseria meningitidis MC58
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 19526 - protein, 299 aa, Oryza sativa
MARLVLLVVLLLLLSVTGETSATGGGGEGGRFDASRTVDVSWSPRVFLYEGFLSDVECEHLIALAKQGRMERSTVVNGKSGESVMSKTRTSSGMFLIRKQDEVVARIEERIAAWTMFPAENGESMQMLRYGQGEKYEPHFDYIRGRQASARGGHRIATVLMYLSNVKMGGETVFPDAEARLSQPKDETWSDCAEQGFAVKPTKGSAVLFFSLYPNATFDPGSLHGSCPVIQGEKWSATKWIHVRSYDENGRRSSDKCEDQHALCSSWAAAGECAKNPGYMVGTSESPGFCRKSCNVCTS

SEQ ID NO: 19527 - protein, 209 aa, Enterococcus faecalis V583
MKDSQPIIIGVTGGSGSGKTSVSRAIFNNFPDHSIMMLEQDSYYKDQSHLSFEERLNTNYDHPFAFDTDLLIQHVEQLLNYQAIEKPVYDYVAHTRSTETVIQEPKEVIILEGILILEDRRLRDLMDIKVYVDTDDDIRIIRRIKRDMEERGRTLDSVIEQYLTVVKPMYHQFIEPTKRYADIIVPEGGENHVAIDLINTKVDSILTKM

SEQ ID NO: 19528 - protein, 691 aa, Oryza sativa
MHGRPRRPDKPEDAAAAEAKAAKLRVLQAQVLHNHHSRTYTKEALGLSFKLLEINPEAYTAWNYRKLAFQHNIGELSEPEAIKSAIDDELRVVEVALRQNPKSYGAWYHRKWLLNQKLAPVDFKCEFGLLDKLLKVDARNFHGWNYRRFLARFMGVPEEEELKYTMDKISDNFSNYSAWHNRSILLSNLLIKQSKGFESKQKIFSEEFELVTQALFTDPSDQSGWFYHLWLLAQTSSPENPQLIASWPSNGSNLSLSSLSSICCYSLKEGILPIVLYFNEPVKGLSSSSVSLNSDLVVSKNIQWRPLSVTDSGHSNCWVTYLEVSNLECNSLQQFSVEVSITNSDEIVSRSGSNYNCPVHFSFTFELSNNDSTAKDIDPIHELISWDFSEPLLSHVNPSCICFEQLKITNSLVHKESNWHLERLSDEIDLFRELHDDNSKFAKLTLARLLLACAAIKSRGSSLVERKGYCEESLGLFNDLIDLDPSHKRYYEDERSLVLMDQLTCDMEAFKKYCSVKALPKLAPLNHVQLCRLSLTRIGFAERLLWVQMLDLSHNNLRSIEGLEALQQLVCLNLGNNQISSFTALEPLTKIISLKVLDLSCNEIGTHPIDTTRYICPSPFSHRVEACEAFEECRKKNINVEEFWDAILFFKHVNLVQLCLEGNAVTNKENLRTLVVTLNPSLKWFDGKFVH

SEQ ID NO: 19529 - protein, 270 aa, Zea mays
  unsure (1)..(270): unsure at all Xaa locations
HAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCXDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSASNPDQEPVTFXAGHLKTVSSLVFFPQXRPKTILST

SEQ ID NO: 19530 - protein, 498 aa, Chloroflexus aurantiacus
MSTPRVFHNLIGGEFVPAQSGKTFERRNPADTRDVVGIFADSDERDVHAAVEAAKAAFPQWSKVPAPKRGEILLRAAELLQARKEQYSRDLTREMGKPLFEAGGDIVEAIGMAQYAGSEGRRMHGVTTPSELPNKFQMSIRQPIGVVGLITPWNFPMAIASWKMLPAIVCGNTVVIKPGEDASVSTYNLVQCLMEAGLPPGVVNIVTGYGPRAGQPLVEHPDVPVISFTGSTETGRLVYELGARRIKRVSLEMGGKNPLIVMPDADLDLALDGVLWAAFGTTGQRCTATSRLIVHRAVAKELVERIVARAQSLRVGNGLDPATEMGPLVNEKQLQRVLNYIDIGKQEGATLLCGGYRLTGGDYDYGYFIAPTVFTNVTSQMRIAREEIFGPVLSVIEVDSLDEAVAIANDVAYGLSSAIYTRDINAAFRAMQALQAGIVYINAPTIGAEIHLPFGGVKATGNGHREAGPTMLDVFSEWKSVYIDYSGALQRAQIDNAD

SEQ ID NO: 19531 - protein, 269 aa, Glycine max
FSLVFPFISISSLFCFDDRCNHYRRRCRIRAPCCNEIYSCRHCHNEAASLLKNPFDRHELVRQDVKQVICSVCDTEQPVAQVCTNCGVKMGEYFCNICKFFDDDVEKEQFHCDDCGICRVGGRDNFFHCKKCGSCYAVGLHDNHLCVENSMRHHCPICYEYLFDSLKDTIVMKCGHTMHHECYLEMIKNDKYCCPICSKSVIDMSKTWKRIDEEIEATVMPEDYRNRKVWILCNDCNDTTEVYFHILGQKCGHCRSYNTRAVAPPVLPQ

SEQ ID NO: 19532 - protein, 288 aa, Triticum aestivum
YFRLAKVSPAKTLSSHLVLPRATLSSFANADDGSGAKPDASGEQSAGSELSEMAKAFHISPRMAMSISVVIAFAALTVPLAMRSLLFHGTTKMKVLAYLTLLSGFYMAWNIGANDVANAMGTSVGSGALTLRQAVLTAAVLEFSGAFLMGTHVTSTMQKGILVTSVFQGNDSLLFAGLLSSLAAAGTWLQVACSYGWPVSTTHCIVGAMVGFGLVYGGVNAVFWSSLARVSSSWLISPLMGAAVSFLVYKCIRRFVYSAPNPGQAAAASAPIAVFTGVTAISFAAFPL

SEQ ID NO: 19533 - protein, 190 aa, Cyanophora paradoxa
MILLIDNYDSFTYNLAQYLSELNIKVLVKRNDKITLDEIKNLNIQGIIISPCPGGPEDSGISQGIIKYLGNQIPILGVCLGHQTIGHVFGGKIIKAPKLIHGKPSIIFHDGKGVFQNLKNPITATRYHSLIIEKESCPDELEITAWTEDGLIMGIQHKKYKQLQGIQFHPESILTESGKQILQNFINCLN

SEQ ID NO: 19534 - protein, 409 aa, Glycine max
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 19535 - protein, 370 aa, Agrobacterium tumefaciens
MTVRSVFLLPGDGIGPEAMTEVRKLIEYMNSAHNAGFTVSEGLVGGSAYDAHGVAISDADMEKALAADAILFGAVGGPKWDGVPYEHRPEAGLLRLRKDLELFANLRPAICYPALAAASSLKPELVEGLDILIVRELTGGVYFGEPKQIIDLGNGQKRGIDTQIYDTFEIERIASVAFELARSRDNRVCSMEKRNVMKSGVLWNQVVTETHAAKYKDVQLEHMLADAGGMQLVRKPKQFDVIVTDNLFGDMLSDVAAMLTGSLGMLPSASLGAPDAKTGKRKAMYEPVHGSAPDIAGKSIANPIAMIASFAMCLRYSFNMVDEATKLEAAIANVLDKGIRTADIMADGCRQVGTSDMGDAVLAEFKALSA

SEQ ID NO: 19536 - protein, 384 aa, Fusobacterium nucleatum subsp. vincentii ATCC 49256
MRMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDKKGWYKGTANAIYQNIKFIEEYDPEYVLILSGDHIYKMNYNKMLQFHIQKEADVTIGVFKVPLKDAPSFGIMNTNDDMSIYEFEEKPKEPKSDLASMGIYIFNWDLLKEYLDEDEKNPNSDNDFGKNIIPNMLNDGRKLFAYPFKGYWRDVGTIQSFWDAHMDLLSEDNELDLFDKSWRVNTRQGIYTPSYFEKGSKVQNTIIDKGCLIEGEIKHSVIFSGVKVGKNTKIIDSIIMADTEIGNNVTIRKAIIANNVKITDNINIGDGEKIAVVGEKKIIDSQSLVK

SEQ ID NO: 19537 - protein, 336 aa, Medicago truncatula
MASFKTLKSTFLILCLLASFFLNPIKAHGGHDDSDHDSDNINIRSRSLVLVKIWCLIILFVFTFIGGVSPYYFRWNEVFLLLGTQFAGGVFLGTSMMHFLSDSNETFEDLTKKTYPFAFMLACSGYLLTMFGDCVVVYVTSNNQREAKVEELEGGRTPQEEEGTTELAMDESNVAFMKTTNVGDTILLILALCFHSVFEGIAVGISGTKEEAWRNLWTISLHKIFAAIAMGIALLRMLPKRPLITTAGYSFAFAISSPIGVGIGIAIDATTEGKTADWMYAISMGIACGVFVYVAINHLISKGFKPQRKSRFDTPWFRFLAVLFGVAVIAVVMIWD

SEQ ID NO: 19538 - protein, 179 aa, Glycine max
  unsure (1)..(179): unsure at all Xaa locations
MASSMISSPAVTTVNRAGAGMVAPFTGLKSMAGFPTRKTNNDITSIASNGGRVQCMQAXWHPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 19539 - protein, 385 aa, Capsicum annuum
MIRGAACFRKLFQSSALSSKFTTRYYTAQAAVQPAIYSSDEESGSIDWDNLGFKLMQTDYMYVTKTSDDGIFRQGQLDRYGNIQLSPSAGVLNYGQGLFEGTKAFRREDGRLFLFRPEQNAIRMQIGAERMCMPAPSTDQFVDALKQTALSNKRWIPPPGKGSLYIRPLLIGTGPILGLAPAPEYTFLVYACPVGNYFKEGTAPLNLYVEEDVHRASRGGAGGVKSITNYAPVLKAMKKAKANGYSDVLYVDAVNKKYIEEVSSCNIFVVKGNVVSTPIAKGTILEGVTRKSIMDIALDLGYTVEERLIEADELISADEVFCTGTAVGVAPVGSITYKGQRIEYKISSDLSCKKFYSRLVGIQKGVIKDERNWIVEIESSYLVQD

SEQ ID NO: 19540 - protein, 450 aa, Staphylococcus xylosus
PRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYG

SEQ ID NO: 19541 - protein, 239 aa, Glycine max
CAKQSDKFNDQLMSNLEVKRVVSGEGFTCGEVNDGGLICWGPTSENLGNINISNVTDSFAVLVAGRSAVCGVFNVSGELKCWGDPVSYSDPPLDSVRLVSLSAGANHFCGVRMDNHEVECWGDLNSSVVPKGNGFMAIASSDFTTCGIREDDLLLDCWLVNASKPDFDPPLELSSPGLCRASECGVDEFAFNVSVLNELALTSVCVREDLRICSPCGSNCSKRFFLSSECSTNADRVCT

SEQ ID NO: 19542 - protein, 294 aa, Bacteroides fragilis
MKGIVLAGGSGTRLYPITKGVSKQLLPIFDKPMIYYPISVLMLAGIREILIISTPDDLPGFQRLLGDGSDFGVRFEYAEQPSPDGLAQAFIIGEKFIGDDSVCLVLGDNIFYGDGLTEMVQFAVNKADLENKATVFGYWVSDPERYGVAEFDRSGNVLSIEEKPQKPKSNYAIVGLYFYPNKVVEVAKNIKPSSRGELEITTVNQRFLSNRELKVQLLGRGFAWLDTGTHDSLSEASTFIEVIEKRQGLKVACLEGIALRKGWISPEKMKALAQPMLKNQYGQYLLKVIDDLFV

SEQ ID NO: 19543 - protein, 506 aa, ASPERGILLUS NIDULANS FGSC A4
MDEGGVHQRRKSDAKGGDTPELQPADMEDILDSGSDYFSPPGSPTTRPRLSRSSLSYQDDWETFPPLDQLTVFDLLDNLSLSQRLERLQRSLNLQREKVKKQQEKLRSTSKNARDRVVGELKRRVPTADEQLEKYRRRMKTGVERLSQRWNAASAVTLREKISFIAGVLNIFISGYLLGSNPEYFYIWFSAQLAYFMPIRFYRYHSIGYHYFLADLCYFVNVLCMLSIWVFPQYKRLFISTFCLTFGNNAVAIAMWRNSMVFHSMDKVVSLFIHIMPPVTLHCIVHLTPLDVMKERFPAAYEIKSSEPGSPEHFGLLSMMLWATVPYVIWQLSYHLFITVRRADKIAAGRPTSFTWLRKSYAKAWIGRLVLSLPETLQAPAFMLIQYTYALLTMIPCPIWLWSRWASGIFITGLFILSIHNGATYYIDVFGKRFQKELEELKKDVARWQSSPEGAITPITPGTTAHAEEKQLNARSSRSNSDNASIEKIPLLDSNGVSTAIEGGTK

SEQ ID NO: 19544 - protein, 521 aa, Solanum tuberosum
MAASIGALKSSPSSNNCINERRNDSTRAVSSRNLSFSSSHLTGDKLMPISSLRSQGVRFNVRRSSLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGLVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPLVASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVEIINKDNVQEAARETDGYFIKSGIVTVIKDALIPSGIII

SEQ ID NO: 19545 - protein, 392 aa, Zea mays; identical to SEQ ID NO: 802

SEQ ID NO: 19546 - protein, 529 aa, Oryza sativa (japonica cultivar-group)
MAVSLVVVVVVVIAIVVPLLYLVLLPAWKPARRDDGDGGMRRRLPPSPPWGLPLLGHLHLLGALPHRALRSLAAAHGPVLLLRLGRVPVVVVSSAAAAEEVMRTRDLEFASRPRVAMAERLLYGGRDVAFAPYGEYWRQTRRICVVHLLSARRVLSFRRVREEEAAALVARVRAAGGAVDLVEHLTAYSNTVVSRAVFGDESARGLYGDVDRGRVLRKLFDDFVELLGQEPMGELLPWLGWVDALNGMEVKVQRTFEALDGILEKVIDDHRRRRREVGRQMDDGGGGDHRDFVDVLLDVNETDMDAGVQLGTIEIKAIILDMFAAGTDTTTTVIEWAMAELITHPDAMRNAQDEIKAVVGITSHITEDHLDRLPYLKAVLKETLRLHPPLPLLVPHEPSSDTKILGYSIPACTRIVINAWTIGRDQATWGEHAEEFIPERFLESGLDYIGQDFVLVPFGAGRRGCPGVGFAVQAMEMALASLLYNFDWETRVVDRRSEFGTSSLDMSEMNGLSVRLKYGLPLIAISRFP

SEQ ID NO: 19547 - protein, 398 aa, Hordeum vulgare subsp. vulgare
VQTPVIVRFSTVVHERGSPETLRDPRGFAVKFYTREGNFDLVGNNMPVFFIRDGMKFPDMVHAFKPSPKTNMQENWRVVDFFSHHPESLHMFTFLFDDVGIPLNYRHMDGFGVNTYTLISRDGKAHLVKFHWKPTCGVKCLLDDEAVTVGGTCHTHATKDLTDSIAAGNYPEWKLFIQTIDADHEDRFDFDPLDVTKTWPEDIIPLQPVGRMVLNKNIDNFFAENEQLAFCPAVTVPGIHYSDDKLLQTRIFSYADTQRHRLGPNYLMLPVNAPKCAHHNNHHDGLMNFIHRDEEVNYFPSRFDPTRHAEKYPMPPRVLSGCREKCIIDKENNFKQAGERYRSFDPARQDRFLQRWVDALTDARVTHEIQSIWVSYWSQCDASLGQKLASRLKIKPNM

SEQ ID NO: 19548 - protein, 360 aa, Zea mays; identical to SEQ ID NO: 16684

SEQ ID NO: 19549 - protein, 290 aa, Pisum sativum
MEKQGQELLQQHHQQQQQQALKCPRCDSSNTKFCYYNNYSLSQPRHFCKACKRYWTRGGTLRNVPVGGGYRRNNKRSTSSSNGPTSTTTLIKRPISTIETATTSNSSSPSSTHSSTSNHMNPMFYGLSSTNNPCDPNLPFSRFNITSRLSTSSGYDLQPQMNFFGLGFSSGFENNGYTNGFNTSNNNYDSIFSSSTSASNNTSVMPSVLSSTLLQHKFFDDGLKYGSDAGSNGAFQDLQFGSKMQNQMEHIGGFYDPASSIYLNATSSSAIGVWNDQGANNIGSSVTSLI

SEQ ID NO: 19550 - protein, 506 aa, Pseudomonas putida KT2440
MIYAQPGTPGAVVSFKPRYGNFIGGEFVQPLAGQYFINSSPVNGQPIAEFPRSTAQDVERALDAAHAAAEAWGKTSVQDRARVLLKIADRIEQNLEVLAVTESWDNGKAIRETLNADVPLAADHFRYFAGCIRAQEGGVGEINEGTVAYHIHEPLGVVGQIIPWNFPLLMAAWKLAPALAAGNCVVLKPAEQTPLSITVFAELIADLLPAGVLNIVQGFGREAGEALATSKRIAKIAFTGSTPVGSHIMKCAAENIIPSTVELGGKSPNIFFEDIMQAEPAFIEKAAEGLVLAFFNQGEVCTCPSRALIQESIYEPFMAEVMKKIAKITRGNPLDTETMVGAQASEQQYDKILSYLEIAREEGAQLLTGGGAERLQGDLASGYYIQPTLLKGNNKMRVFQEEIFGPVVGVTTFKDEAEALAIANDSEFGLGAGLWTRDINRAYRMGRGIKAGRVWTNCYHLYPAHAAFGGYKKSGVGRETHKMMLDHYQQTKNLLVSYDINPLGFF

SEQ ID NO: 19551 - protein, 327 aa, Pseudomonas stutzeri
CIGCHTCSITCKNVWTSREGMEYAWFNNVETKPGIGYPKEWENQDKWKGGWVRNGDGTINPKIGGKFRVLANIFANPDLPTIDDYYEPFDFDYQNLHTAPISEHQPVARPRSLISGQRMEKIEWGPNWEEILGTEFAKRRKDKNFDKVQADIYGQYENTFMMYLPRLCEHCLIPACCASCPIGAIYKREEDGIVLIDQEKCRGWRMCISGCPYKKIYFNWKSGKSEKCIFCFPRIEAGMPTVCAETCVGRIRYLGVLLYDADRIHEVASTVNEQDLYAKQLEIFLDPFDPKVIEQALNDGVPMSVIEAAQKSPVYKMAVDWNAWPCR

SEQ ID NO: 19552 - protein, 478 aa, Bifidobacterium longum NCC2705
MDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIACAVWYVKPSNWQPFSPYGVYTFQPGSTQPYGIVPAASIVFFSFIGFDAVSSSAEETINPNKTLPRGILLSLAVSTVLYIVMTMIMTGVVPYQDFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAIWFGLGLIVYFGYSRKRSKLGLEQKAGADTKVAATED

SEQ ID NO: 19553 - protein, 281 aa, Pseudomonas syringae pv. syringae B728a
MSQERRFSFEFFPTKTDAGHEKLLTVARQLATYNPDFFSCTYGAGGSTRDRTLNTVLQLENEIKVPAAPHLSCVGDSKDDLRNLLAQYKDAGIKRIVALRGDLPSGMGMASGELRHANDLVSFIRQESGSHFHIEVAAYPEMHPQARNFEDDLKHFVNKANAGADSAITQYFFNADSYFNFVERVEKMGVSIPIVPGIMPITNYSKLARFSDACGAEIPRWIRKQLEAYGDDVQSIQAFGEEVITQMCERLLQGGAPGLHFYTLNQAEPSLAVWNNLQLPR

SEQ ID NO: 19554 - protein, 423 aa, Triticum aestivum
  unsure (1)..(423): unsure at all Xaa locations
MERSDSLSESPRKRNGLLRDQVQLVKRKDTSRYEIVPFPEPLSFEKGFFVMIRAIQLLVQNNEGIIFVGVAGPSGAGKTVFTEKVLNFMPSVAVISMDNYNDASRIVDGNFDDPRLTDYDTLLENIHGLKEGRSVQVPIYDFKMSCRTGYXDVPSSRIVIIEGIYALSDKLRPILDLRVSVTGGVHFDLVKRVLRDIQRAGQEPEEIIHQISETVYPMYKAFIEPDLKTAHIRIINKFNPFSGFQNPMYILKSPRSLTPDQIKAALGEDQTESNEETYDIYLLPPGEDPEACQSYLRMRNREGKYNLMFEEWVTDNPFIISPRITFEVSVRLLGGLMALGYTIAAILKRSSRVFSDGKATVKIDWLEQLNRRYIQVQGRDRLYVKFVAEQLGXLDGSYIPRTYIEQIQLEKLMNDVMALPDDL

SEQ ID NO: 19555 - protein, 534 aa, Arabidopsis thaliana
MDGVSPKFVLPETFDGVRMEITGQLGMIWELVKAPVIVPLLQLAVYICLLMSVMLLCERVYMGIVIVLVKLFWKKPDKRYKFEPIHDDEELGSSNFPVVLVQIPMFNEREVYKLSIGAACGLSWPSDRLVIQVLDDSTDPTVKQMVEVECQRWASKGINIRYQIRENRVGYKAGALKEGLKRSYVKHCEYVVIFDADFQPEPDFLRRSIPFLMHNPNIALVQARWRFVNSDECLLTRMQEMSLDYHFTVEQEVGSSTHAFFGFNGTAGIWRIAAINEAGGWKDRTTVEDMDLAVRASLRGWKFLYLGDLQVKSELPSTFRAFRFQQHRWSCGPANLFRKMVMEIVRNKKVRFWKKVYVIYSFFFVRKIIAHWVTFCFYCVVLPLTILVPEVKVPIWGSVYIPSIITILNSVGTPRSIHLLFYWILFENVMSLHRTKATLIGLFEAGRANEWVVTAKLGSGQSAKGNTKGIKRFPRIFKLPDRLNTLELGFAAFLFVCGCYDFVHGKNNYFIYLFLQTMSFFISGLGWIGTYVPS

SEQ ID NO: 19556 - protein, 811 aa, Desulfitobacterium hafniense
MFSDKNGFKDAYLEKFAEIKGKSIEEGTLWDKYHTLVVLLREEISLSRAFINYADPKNRPAKQVYYFSMEFLIGKLLHNYLINIGIQDIVAEGLEELNIDLQELLAQECDAGLGNGGLGRLAACFLDSMAFLGIAGHGNGIRYKYGLFEQKIVNGYQTEVADHWLKNGYPWEVRKPDKSVVIKYKGKVRVENIDDRLVFHHENYEPVLAVPYDIPIVSYENPFLVNNLRLWSAEPLSSELDLALFNQGNFTQALSNKSEVEAISYILYPEDSNLAGRELRLKQEYFFVAAGLATIVRNYKKNHGSLRDFSQGVSIHINDTHPALCIPELMRILIDEEGMDWEESWNITVDAISYTNHTIMPEALEKWPLDLFRNLLPRITMIIEEIDRRFKEKLLRRFFNSEELFRSTPIIKEGQIYMANLAMIGSHSVNGVAKLHTEILKKHVFKDFHRIFGYKFTNLTNGVNHRRFLLTANPLLSELITEGIGPGWKTNAGELAELHRFKEDSAFLDRLAQVKYQNKLRLAEIIAMGQGIQIDPHSLYDVHVKRIHAYKRQLLNVLKVMDLYNRLLADPGSVQGTYTFIFGGKAAPGYHYAKSIIKLIHVIADKINQEPRIKEQLKVVFMENFNVSSAERIYPAADLSEQISTAGKEASGTGNMKFMMNGALTIGTLDGANVEIREAVGEDHIFIFGLTAEEILAHNLNRTYRSWDEYHANPCLENILEQLISKQFMENDWEFRTVYDSLLLYNDEFFVLKDFAAYMKTFGEAADRYAAQEQWLRSSLHNIAESGVFSTDRTIREYAHQVWRVRCRRMD

SEQ ID NO: 19557 - protein, 104 aa, Oryza sativa (japonica cultivar-group); identical to SEQ ID NO: 4087

SEQ ID NO: 19558 - protein, 205 aa, Glycine max
VEQRSYKGRHCKKFYTEEGCPYGDSCTFLHDEQSKNRESVAISLGPGGYGGGGGGGGGVGGGASGGNGGANAAGNGPNSKPSNWKTRICNKWEMTGYCPFGNKCHFAHGATELHRYGGGLMEGENRDAASAVAGDTNKGVPSKASADNVVAAVTLVAHSDVYHIGVPSQRPSSMVIQRPGQRAHQKWKGPDKISRIYGDWIDDIE

SEQ ID NO: 19559 - protein, 206 aa, Triticum turgidum
MSMSCGLCGANNCPRLMVSPIHHRHHHHQEHQLRQHQFFAQGNHHHHHPVPLPPANFDHSRTWTTPFHETAAAGNSSRLTLEVGAGGRPMAHLVQPPARAHIVPFYGGAFTNTISNEAIMTIDTEMMVGPAHYPTMQERAAKVMRYREKRKRRRYDKQIRYESRKAYAELRPRVNGCFVKVPEAMASPSSPASPYDPSKLHLGWFR

SEQ ID NO: 19560 - protein, 282 aa, Zea mays
MACSHLAAAGGSSPAAAAVVRSPTHSPAAAFARLRSTPRFSSAGLSVKGSRAAFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPDGKKIILNFVRFIEELEKQRS

SEQ ID NO: 19561 - protein, 506 aa, Zea mays
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 19562 - protein, 314 aa, ASPERGILLUS NIDULANS FGSC A4
MASTTKESAKPAVDFLHHPYTRAALPFINGGLAGMTATVVIQPIDMIKVRLQLAGEGVRTGPRPSALGVARNIIASGKVLDLYTGLSAGLLRQAVYTTARLGFFDTFMKALTKNADTANRKVTFAERAGAGLTAGGIAAMIGNPADLALVRMQSDGLKPPEARAHYRSVIDALFRISKAEGVTALWAGAFPTVVRAMALNLGQLAFFAESKAQLKTRTSLSAQNQTFAASAIAGFFASFLSLPFDFVKTRLQKQQKDPKTGQLPYKGMFDCARKVVRDEGWLRFYRGFGTYYVRIAPHAMVTLIVADYLNLITK

SEQ ID NO: 19563 - protein, 165 aa, Rhizobium sp. SDW058
MFADGVMFDGSSIGGWKAINESDMVLMPDPATVHMDPFFAQSTMVIVCDILDPVSGEAYNRDPRGIAKKAEAYLKASGIGDTVFVGPEPEFFVFDDVKYKADPYNTGFKLDSSELPSNDDTDYETGNLGHRPRVKGGYFPVPPVDSCQDMRSEMLTVLTEMGVTV

SEQ ID NO: 19564 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGVCKKVIISAPSADAPMFVCGVNLDAYDSKYKVISNASCTTNCLAPLAKVIHDKFGIVQGLMTSVHATTATQKTVDGPSNKDWLGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 19565 - protein, 521 aa, Lycopersicon esculentum
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGEYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDAERKLLAAKGSVPIGIGKNCLYKRAIIDKNARIGDNVKIINKDNVQEAARETDGYFIKSGIVTVIKDALIPSGIVI

SEQ ID NO: 19566 - protein, 236 aa, Zea mays
PRVREELVTSGYDNKVFRIPLNGNQCGDAESVDIGGQPNALNLAIQKPEFALITTDSGIVLLHNSKVISTTKVNYAITSSSVSPDGTEAVVGAQDGKLRIYSISGDTLTEEALLEKHWGAITSIHYSPDVSMFASADTNREAVVWDRASREVKLKNMLYHTARINSLAWSPDSRLVATGSLDTCAIVYEIDKPVASRVTIKGAHLGGVHGLTFLDNDILVTAGEDACIRVWKVVQQ

SEQ ID NO: 19567 - protein, 428 aa, Pyrococcus abyssi [sequence omitted]

SEQ ID NO: 19568 - protein, 461 aa, Prunus persica
ADAIKAGLDLDCGPFLAIHTEAAVRRGLVSQLEINWALANTMTVQMRLGMFDGEPSAHQYGNLGPRDVCTPAHQQLALEAARQGIVLLENRGRSLPLSTRRHRTVAVIGPNSDVTVTMIGNYAGVACGYTTPLQGIGRYTRTIHQAGCTDVHCNGNQLFGAAEAAARQADATVLVMGLDQSIEAEFVDRAGLLLPGHQQELVSRVARASRGPTILVLMSGGPIDVTFAKNDPRISAIIWVGYPGQAGGTAIANVLFGTANPGGKLPMTWYPQNYVTHLPMTDMAMRADPARGYPGRTYRFYIGPVVFPFGLGLSYTTFAHNLAHGPTLVSVPLTSLKATANSTMLSKTVRVSHPDCNALSPLDVHVDVKNTGSMDGTHTLLVFTSPPDGKWASSKQLMGFHKIHIATGSEKRVRIAVHVCKHLSVVDRFGIRRIPLGEHKLQIGDLSHHVSLQTNLGEIKV

SEQ ID NO: 19569 - protein, 332 aa, Bacillus cereus ATCC 14579
MDTLLILTVLVVICALAFDFINGFHDTANAIATAVSTKALKPRHAIIMAAIMNFLGAMTFTGVAKTITKDIVDPFALQNGSLVILAALLAAIAWNLITWYYGIPSSSSHAIIGSIAGAAIAAAGISSLNLKGFIKIIEALIISPIIAFVIGYIVYSIFKVVFKNFNLTKTNKNFRIFQIFTAALQAYTHGTNDAQKAMGIITMALMANNYHTSSDIPFWVQLSCAIAMGLGTSVGGWKIIKTVGGQIMKIRPVNGVAADLSSSLVIFGATFIHLPVSTTHVISSSILGVGASHRVKGVKWGTAKRMLITWVITLPISASLAALFYYLLHFVF

SEQ ID NO: 19570 - protein, 470 aa, Glycine max
MGSMHIETPETFADGSKNFDDDGRAKRTGTWITASAHIITAVIGSGVLSLAWAIAQMGWVAGPAVLFVFSLITYFTSTLLADCYRSPDPVHGKRNYTYSEVVKANLGGRKFQLCGLAQYINLVGVTIGYTITASLSMGAVKKSNCLHKHGHQDECKVKDNAFMIAFACIQILLSQIPNFHKLSWLSIVAAVMSFAYSSIGLGLSIAKIIGGGHVRTTLTGVEVSGTEKVWKMFQAIGDIAFAYAFSNVLIEIQDTLKSSPPENKVMKRASLIGIMTTTLFYVLCGCLGYAAFGNDAPSNFLTGFGFYEPFWLIDFANVCIAVHLVGAYQVFVQPIFGFVEKWSKENWTESQFINGEHTLNIPLCGSYNVNFFRVVWRTAYVIITAVVAMLLPFFNDFLALIGALSFWPLTVYFPIEMYIKKSNMQRFSFTWTWLKILSWVCLIISIISLVGSIQGLSVSIKKYKPFQAEQ

SEQ ID NO: 19571 - protein, 104 aa, Glycine max
RANRLEARRRQKGNQIGSVTESIEAIRMSKKAGWGVMASHRSGETEDTFIADLSVGLATGQIKTGAPCRSERLAKYNQLLRIEEELGAEAVYAGANFRTPVEPY

SEQ ID NO: 19572 - protein, 488 aa, Streptomyces coelicolor
MPENNQKPLTTVAGPPVPDNQNSLTSGPRRPMLLQDVWFLEKLAHFDREVIPERRMHAKGSGLFGTFTVTHDITRYTSAKIFSEIGKKTPLFTRFSTVAGERGAADAERDIRGFAVKFYTDEGNWDLVGNNTPVFFFRDPLKFPDLNHAVKRDPRTNLRNAENNWDFWTNLPEALHQVTIVMSDRGIPASYRHMHGFGSHTYSLINAEGERFWVKFHHRTQQGIKNLTDAEAEALVGKDRESHQRDLFDAIEDGDFPKWKLFIQVMPEADAENYRFHPFDLTKVWSKKDYPLIEVGEWELNRNPDNYFADVEQAAFSPANVVPGIEASPDRMLQGRLFSYGDAQRYRLGVNHHHQIPVNAPKNPVNSYHRDPAMRVDGNQGATPGIEPNSYGRWQEQPAYRDPAQAVGAVADRFNYREDDDNYFEQPGNLFRQMSPEQQQVLFENTARAIDGASAQTIERHIGNCTQADPAYGAGVRKAIEALAAGNL

SEQ ID NO: 19573 - protein, 295 aa, Bacteroides fragilis
MKGIVLAGGSGTRLYPITKGVSKQLLPIFDKPMIYYPISVLMLAGIREILIISTPDDLPGFQRLLGDGSDFGVRFEYAEQPSPDGLAQAFIIGEKFIGDDSVCLVLGDNIFYGQGFTRMLNEAVRIAESESKATVFGYWVSDPERYGVAEFDENGNVFSIEEKPQKPKSNYAVVGLYFYPNKVVEVAKSIRPSSRGELEITTVNQNFLSDKELRVQLLGRGFAWLDTGTHDSLSEASTFIEVIEKRQGLKVACLEGIALRKGWISPEKMKALAQPMLKNQYGQYLLKVIDELYVK

SEQ ID NO: 19574 - protein, 429 aa, Mycobacterium leprae [sequence omitted]

SEQ ID NO: 19575 - protein, 255 aa, Leuconostoc mesenteroides subsp. mesenteroides ATCC 8293
AWFYDACGVCDYCVSGNETFCRKVRNSGYTIDGAMSQQVVVNAKYAVKVPEGLDPVEATSITCAGVTMYKALKVGETKPGEWVSVHGAGGLGNLAVQYAHSVFGAHVAVIDGNDDKLAAAKANGAEVLVNRKKEDVVAKVNELTGGVHNAQVTAVNDAAFSQAVNVLRPMGKLVAVALPQGDMALNIAKTVLDGIEVRGSLVGTRADLKEAFQFGAEGKVKPIVETVAFQDMNEIIDEMKAGSITGRKVIDFTTL

SEQ ID NO: 19576 - protein, 601 aa, Thermobifida fusca
MRSRQHGDRPRKHLGRRRQTPPQRHHRHRLRGRADRDRHPRRRHRQPRLRGSGPDQPGRTRRRRRLGPRHPVNRPRRPRGSRTRAPGSRRQAPGTHHPGPGRPPVRHCPRRRHRPRPGRRQRLCPRTPGGHDRRRPVRCRPRPQRGSDLHRRPLSGVAGRLLRGFQPRAPHRRGGRPLLGTERAELPARHPRRRIRPCRTGRSRPPRGGPRRSRRPARARCGCHRAHPPGGTAGVSDFGHTGFSIDDLPLRDDLRGQAPYGAPQLTVKAVLNTNENPYPPSPELVEAIGRAAAEAAVGLNRYPDREATALRQALADYLGHGVDAANVWAANGSNEILQQILQAFGGPGHKALGFEPSYSMHPIIARGTATEWVSVPRTADFDVDADAAVAAVKEHEPSVVFLTSPNNPTGTALPLATVEAIAAAAPGVVVVDEAYAEFRREGTPSALSLLRTYPNVIVSRTMSKAFAMAGVRLGYLAAHPAVVDALQLVRLPYHLSTVTQAVALTALRYADELLSAVATLRAERDALVDWLRAHGFEVADSDANFVLFGRFPDRSAVFQHLLDQGVLIREVGPPEWLRVTVGTPEEMAIFREALLTATGRA

SEQ ID NO: 19577 - protein, 314 aa, Polarella glacialis
RIGRMVFQAICDQGLLGTKIDVVGVVDMSTDAEYFAYQMKYDSTHGKFKHDVKIDGADTLVVNGHKIKCIMASRDGPKALPWGELGVEYVIESTGLFVESEKAQGHINAGCKKVIISAPGKGAVKTLVMGVNHTEYDKAAHNIVSNASCTTNCLAPLCHVILKEGIGIEKGLMTTIHAYTATQKTVDGVSAKDWRGGRAAACNIIPSATGAAKAVGEVLPVTKGKLTGMAFRVPVPDVSVVDLTFTAEKDTSIEEIDKLLKAASETYMKGFLSYTTEELVSTDFIHNTHSSIYDSKATLQNNLPGEKRFFKVVS

SEQ ID NO: 19578 - protein, 460 aa, Portieria hornemanii
WDPDYVVKDTDILALFRVSPQPGVDPIEASAAVAGESSTATWTVVWTDLLTACDLYRAKAYKVDSVPNATGQYFAYIAYDIDLFEEGSIANLTASIIGNVFGFKAVKALRLEDMRIPFAYLKTFQGPATGVIVERERMDKFGRPFLGATVKPKLGLSGKNYGRVVYEGLKGGLDFLKDDENINSQPFMRWKERFLYSIEGVNRSIAASGEVKGHYMNITAATIEDMYERAEFAKHLGSVIIMIDLVIGYTAIQTMAIWARKNDMILHLHRAGNSTYSRQKIHGMNFRVICKWMRMAGVDHIHAGTVVGKLEGDPLMIKGFYRTLLDPYLPIDLPQGLFFEQDWASLRKVTPVASGGIHCGQMHQLLDYLGDDVVLQFGGGTIGHPDGIQAGATANRVALESIVMARNEGRDYVAEGPQILQDAAKTCGPLQTALDLWKDITFNYTSTDTADFVETPTANV

SEQ ID NO: 19579 - protein, 548 aa, Glycine max
  unsure (1)..(548): unsure at all Xaa locations
METTRRWFSKFKSNDKMNSAKDKETTGMTKEGSKPPTSEEAPSNVTKQRVEAAKQYIENHYKKQMQSLQERKERRNMLEKKLADAEVSEEEQHNLLQHLEKKEREIMRLQRHKMGADDFEPLTMIGKGAFGEVRICREKATGHVYAMKKLKKSEMLRRGQVEHVKAERNLLAEVDSNCIVKLYCSFQDEXEYLYLIMEYLPGGDMMTLLMRKDILTEDEARFYVGETVLAIESIHKHNYIHRDIKPDNLLLDRNGHMKLSDFGLCKPLDCSNLQEKDFSVGINRSGALQSDGRPVAPKRTQQEQLQHWQKNRRMLAYSTVGTPDYIAPEVLLKKGYGVECDWWSLGAIMYEMLVGYPPFYSDEPMLTCRKIVNWRTSLKFPEEAKLSAEAKDLISRLLCNVDQRLGTKGADEIKAHPWFKGIEWDKLYQMKAAFIPEVNDELDTQNFEKFEEVDNQTQPSSKSGPWRKMLSSKDVNFVGYTYKNYEIVNDDQLPEIAELKKKSTKPKRPSIKTLFDDESATAANQPTQGSFLKLLPTQPEVPEKSESQ

SEQ ID NO: 19580 - protein, 142 aa, Prionitis lanceolata
LTTDLGLFRAAVPSGASTGAYEALELRDGDKSRYNGKGVLKAISNVNELIAPAVAGADVIDQAAFDAIMLELDGTENKAKLGANAILGVSMAACMAGAAAKGIPLYRHISEIAGKGSDPVIMPVPVMNVINGGSHAGNKLAM

SEQ ID NO: 19581 - protein, 361 aa, Streptomyces avermitilis MA-4680
MTTDGRTGAVPRDAHDVVALGESMVTFLPTRPGRLADVPSFERGIGGAESNVACVLAAAGHSVRWAGRVGADGFGDHLVEAIAAYGVDTSAVRRDPARPTGVYFRTAGDRATDAHEVAYYRAGSAASAMTAENMDLDAVRAGRVLHLSGITAALSDGCLGLLRELTARRPARPLVSFDVNHRPGLWRDTDGPRVLLELARGADLVFVGDDEARAAWGLHGPRAIRDALPEPEVLVVKQGGGGATAFERRPGGPGTGDTSTDTVTFVRALQVDVVAAVGAGDAFAAGFLSATLRGLPVRDRLRHGHLMAAAALTVPGDLAVPPARDHADRLAALDDTAWETLRLGPGWTQAVDRAQEEVRTP

SEQ ID NO: 19582 - protein, 519 aa, Triticum aestivum
MAVAGAPPVLQLLPQQWQLILAILLVPLGFLLLRGRSGSGLKLPPGPMRLPFVGNLHQIGPLPHRSLAALARRHGPVMMLRLGMVPTVVLTSPEAAREALKTKDDDCSSRPLSAGPGLLSYGYKDVAFSPWSDYVREMRKLFIIELLSRRRVQSAYYARDAQIDKLIETLTVVGPNPVPLEAHIFATMDRIVGLFAFGESYAGEQFKGQFVPLLNATMDMLGSFSAQDFFPNAVGRLIDRITGVKAHRQRVFRQLDRFFEHIIEQCDGRKATGGGGSDLVQELLDIMKRPAASAAGTFTRDHVKAILMNTFIGSIDTTTVTITWAMAELIRKPRVLQRAQLEIRTAAGGGSRVHQADMPKMSYLRMVLSETLRLHPPATLLVPRETLRPIQVAGYDIPAKTQVIVNAWAISRDPSAWKDPEEFNPERFQDTDVDFNGSHFEFIPFGAGRRICPGLAMGVANAEYILANLLYCFNWALPNGVSREGVNMEEEGVLTYRKKTSLMLVPTPYHPAQEKEEEY

SEQ ID NO: 19583 - protein, 496 aa, Azotobacter vinelandii
MGAGGRGGVAAALRRRPGDQPRRGPGRSLRDLRRTPRHRPVGALRALVPGFPAGSRGRLDAPAPGGPRSPAGAARPRPAAGLRGSRRRHPGAGRGPFARPERRHPGAGRRARDRVRRRRPTDRHPRFPRPAEHRRGSHTCLCGAPPSAVHRPRTPATPREPFVSKQPRRTTMTTHLSAEQLLHAYRVMRTIRVFEERLHIEFATGEIPGFVHLYAGEEASAAGVMAHLRDDDCISSNHRGHGHCIAKGVDVHGMMAEIYGKKTGVCQGKGGSMHIADLSKGMLGANGIVGAGAPLVAGAALAAKLKGSDAVAVAFFGDGASNEGAVFEAMNLAAIMNLPCIFVAENNGYAEATASNWSVACDHIADRAAGFGMPGVTVDGFDFFAVHEAAGAAVARARAGEGPSLIEVKLTRYYGHFEGDAQTYRDMGELKEMREVRDCLKQFRERTIAAGLLDASQLDDIDGEVERQIEDSVIKAKSDPKPPAADLLADVYVSYP

SEQ ID NO: 19584 - protein, 400 aa, Archaeoglobus fulgidus DSM 4304
MRKMRELTTIDETWKLMDELRQRFYFKRESEEVRVEDALDRELAEDVFAAKDMPPFDIATMDGYALKLEDGVREYRIVGEVYAGEVEDRFVNRGECVYITTGAKMPVNADTVVKVEIAEVDGSKMRIREKVNRGKYVLKKGSEVKKGDLILPAKTRIGPQEIAALISAGVERVRVFRRLRAAVFSNGDEIKKGIIADSNSAMISAFLRKLGCEVHFLGVAGDDAEEVREMVEKGVRDYDAVLTSGGVSVGEKDYVVKALKEMGEVLIYKVRQRPGKPMVVAVVNEKPVFALPGKPAGCFTAMLSLRRFFAGDKPFPKVRARIAGDVKLPTKGFSYFLFVKLRDGYAIPAGFRHSHVSIIPYEKYEVSLVSAMARSAVSDGFVVTDRDLRAGEEVEVCLYD

SEQ ID NO: 19585 - protein, 495 aa, Glycine max
  unsure (1)..(495): unsure at all Xaa locations
MDPYKLRPSSAFNSPFWTTNSGAPVWNNNSSLTVGARGPILLEDYHLVEKLANFDRERIPERVVHARGASAXKGFFEVTHDISHLTCADFLRAPGVQTPVIVRFSTVIHERGSPETLRDPRGFAVKFYTREGNFDLVGNNLPVFFVRDGMKFPDMVHALKPNPKNHIQENWRILDFFSHFPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIDPEHEDKFDFDPLDVTKTWPEDIIPLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAETFPIPPGYLXSGRREKCGIEKENNFKQPGERYRSWAXPDRQDRFNRRWVDALSDPRVTHEIRSVXISYWSQADRSLGQKIASRLSMRPNI

SEQ ID NO: 19586 - protein, 306 aa, Ralstonia metallidurans
MSERPTYEVPAATPGATPNTQWLRVAPALFLLLWSGGFVFLKLGLRHADPLTFLALRYACVVGLLIVPCLWIRPAFPPGIKPWLHLGMVGLLIQAGYFSFTYLSLKHGMSAGAVALVTSQQPILIGLLAPAIAGERVDRVRWLGLALGVTGAVIVITSRSSIDVATPAGLIFALLALLAMTGGTLWEKRFGTTVHPVASNLVQYAVGLVVTAPLAYALEPMHVAWTPELFGSLAYLVIGNSIIAISLLLAMIRHGEASRVSALFFLVPPMTAVVAFAVLGESIPLAAWPGMAMAAIGLYLVMGRRS

SEQ ID NO: 19587 - protein, 252 aa, Azotobacter vinelandii
MGNIVFITGATSGFGRAAARRFAAAGWSLVLSGRRLERLQALQEELQGKVPVHIAALDVRDAEAVRQVVAALPEGFRQVRALINNAGLALAPQPAQQVALEDWHTMIDTNVTGLVNVTHALLPTLIASGQGASIVNLGSVAGHWPYPGGHVYGATKAFVEQFGYNLRCDLLGTGVRVTDIAPGMAETEFTLVRTKGDQAASDRLYRGTTPLTAEDIAEQIFYVASLPAHININRLEVMPTRQAWQPFAVDRD

SEQ ID NO: 19588 - protein, 434 aa, Enterococcus faecium
MISITHTGNLFLDTCLSIMYFFLVSYPILGGFVWFIGVWCYVFLYKHKQKEWVDVPLSVEPFITIMVPAHNEEIVIEYTIEYLMTKLNYHNYEVLVTDDGSTDQTPEILARLMKKYANLRVVRIEKNKGKAHAFNIGLAFAKGKLILSNDADTVPEPDALIRYVNYFIRPGARHIAAVTANMDVQNRTKLIAKSQTVEFSSIVGIIKRTQSAVFGGLYAYRGANTMYRKEALIDVGGFRQDRATEDISIAWDHQLNDWLSVFAPEIIFFMEVPVTLKMLYRHRKRWAKGGTEVWLTNFKKVMLHPFKHIGRTIIFIDQTLSIVWSIFFCISVVLFAGLIGHYVYQGNYEQIYITFTFSFVFICFEMVAGFFQLLASLIVDDRRRKLKYLLFAPLYMLLFWIVNAITIVTTFIPAVKTILGYGSGTWKSPERTKK

SEQ ID NO: 19589 - protein, 416 aa, Claviceps purpurea
MTDIPGRRAFKCFNQEFVVDERYTVTKELGQGAYGIVCAAVNNQTKESVAVKKVTNVFSKKILAKRALREIKLLQHFRGHRNITCLYDMDIPRPDVFNETYLYEELMECDLAAIIRSGQPLTDAHFQSFIYQILSGLKYIHSANVLHRDLKPGNLLVNADCELKICDFGLARGFSADPEQNAGYMTEYVATRWYRAPEIMLSFQSYTKAIDVWSVGCILAELLGSRPFFKGRDYVDQLNQILHVLGTPNEETLSRIGSPRAQEYVRNLPVMPKKNFATLFPQANPHALDLLDKMLAFDPSSRISVEQALEHPYLQVWHDPADEPNCPTIFNFDFEVLDDVGEMRKVILDEVIRFRQMVRTASSAEPTTGQAQTAAAGQVPMPQAGGQWKAEDPRPQENTPQGNGLEQDLQAGLDAA

SEQ ID NO: 19590 - protein, 365 aa, Brucella suis 1330
MQKPTRPQPKAGVLDIAAYVPGKEHVEGVAKVYKLSSNETPLGPSPHAREAYRHAGEKLELYPDGQALALRQAIAETQGLNISNILCGNGSDELLGLLCQTYLAPGDETIITEHGFAVYKIQTLAAGATPVTVKEKNERIDVDAILAGVTARTKIVFIANPANPTGTYLPFEEVRRLHAGLPQHVLLVLDAAYAEYVRRNDYEAGLELVSSNENVVMTRTFSKIHGLPGLRIGWIYAPLHIIDAMNRIRGPFNMNSAAIAAGAAAIRDRAHVEKSVAYNEKWLAWLTEEFTRLGLRVTPSVTNFLLIHFPDDAAHSADKADEWLSRRGYILRRVGGYGFPNALRMTVGPEEANRGVVAALTEFLK

SEQ ID NO: 19591 - protein, 387 aa, Bacillus anthracis str. A2012
  unsure (1)..(387): unsure at all Xaa locations
MGENHDKQRQSLLGKDFNENGERNEQAILHSQTVGSRGPVLEQDSVLHEALQEFIHEKILERPVHVKGFGAFGYFQTIYPMSEHTKLSFLQHSNEKVPVMVRFSLAVSTKGTPDTARNVRGFSTKFYTKEGIFDLLCNHIPVFSVRDPMRFPETIQALSPSPKNNLLDPNRFWSFVARAPESIHFVVHLYSDNGTAKSFRRIPGHSVNTYVWRNAEGNRKYVKYHWYPFEGVQSITNEEANKLAAENPDYSGKDLYDAIANGKPVEYGLYVQLMDPKDEAHLSYDPLDDTKAWDEKAYPLIPVGKMVLNKNPENYMEQVEKVAFSPSNLLNGAELSDDKMLQXRANIYSDSQRRRIGPEFRKLAINQQQDWTPANQITSGDGRYVER

SEQ ID NO: 19592 - protein, 336 aa, Oryza sativa
MAPLGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 19593 - protein, 152 aa, Apium graveolens
AIMFYAPVLFSTLGFKDNASLYSAVITGAVNVLSTVVSIYVVDKLGRRILLLEAGVQMFIAQIIIAIVLGIKVTDHSDNLGTAYAVIVVVMICTFVSAFAWSWGPLGWLIPSETFPLETRSAGRSVTVCVNLLFTFVIAQAFLSMLCHFKFG

SEQ ID NO: 19594 - protein, 273 aa, Allantoparmelia alpicola
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRVEKSVTYDQIKETMKKASEGELKGIMAYSEDALVSTDLNGDNHSCIF

SEQ ID NO: 19595 - protein, 466 aa, Eupogodon planus
  unsure (1)..(466): unsure at all Xaa locations
YAKMGYWDPNYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPXXYLKTFQGPATGIIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGEPVMIRGFYNTLLFSYLEINLPQGIFFQQDWASLRKVTPVASGGIHCGQMHXLLDYLGDDVVLQFGGGTIGHPDGIQAGATANRASLEAMVIARNEGRDYVPEGPQILVEAAKTCGPLQTALDLWKDISFNITSTDTADFVETATPNV

SEQ ID NO: 19596 - protein, 208 aa, Zea mays
MLSPPPPKDEIVSAIEKRVAAWTFLPEENAESLQVLRYETGQKYDAHFDYFHDRNNLKLGGQRVATVLMYLTDVKKGGETVFPNAEGSHLQYKDETWSECSRSGLAVKPKKGDALLFFNLHVNATADTGSLHGSCPVIEGEKWSATKWIHVRSFDNPPDVRTDAPCSDDKELCPRWAAIGECHRNPTYMVGTKDTLGFCRKSCGICDA

SEQ ID NO: 19597 - protein, 416 aa, Bostrychia tenuissima
  unsure (1)..(416): unsure at all Xaa locations
EASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMENMYERAEFAKQLGTIIIMVDLVIGYTAIQTMAIWARKNDMILHLHRAGNSTYSRQKIHGMNFRVICKWMRMAGVDHIHAGTVVGKLEGDPLMIRGFYNTLLYAHLDINLPQGIFFKQDWASLRKVTPVASGGIHCGQMHQLLDYLGNDVVLQFGGGTIGHPDGIQAGATANRVALEAMVIARNEGRDYVSEGPQILRDAAKTCGPLQTALDLXKDITFN

SEQ ID NO: 19598 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRGPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 19599 - protein, 274 aa, Prunus persica
DEGPQVPTIDLKEIDSENENVRERCREELKKAAVDWGVMHLVNHGISDELMDRVRKAGKAFFDLPIEQKEKYANDQASGKIQGYGSKLANNASGQLEWEDYFFHLVYPEDKRDLSIWPQTPADYIEATAEYAKELRALATKVLRVLSLGLGLEEGRLEKEVGGLEELLLQMKINYYPLCPQPELALGVEAHTDVSALTFILHNMVPGLQLFYEGKWVTAKCVPNSIIMHIGDTIEILSNGKYKSILHRGMVNKEKVRISWAVFCEPPKEKIILK

SEQ ID NO: 19600 - protein, 752 aa, Penicillium chrysogenum
MADLVDHSPHHATKAAKLASASNVILIDNYDSFTWNIYQYLVLEGATVTVYRNDEVTVEDLVAKKPTQLVISPGPGHPDTDAGISNAVIKHFSGKVPIFGVCMGQQCMITSFGGKVDVTGEILHGKTSELKHDSKGVYQGLPTSLEVTRYHSLAGTHSTIPDCLEVTSRVELGDASGKNIIMGVRHKEFAVEGVQFHPESILTQYGRKMFRNFLELTAGTWDNKQGAAVAAPADKKLSILDKIYAHRKNAVDEQKKIPALRPEALQAAYDLNIAPPQLSFPDRLRQSDYPLSLMAEIKRASPSKGIISANVCAPAQAREYAKAGASVISVLTEPEWFKGTIDDLRAVRQSLEGLPNRPAVLRKEFVFEEYQILEARLAGADTVLLIVKMLDIELLTRLYHYSRSLGMEPLVEVNTPEEMKIAVDLGSEVIGVNNRDLTSFEVDLGTTSRLMDQVPESTIVCALSGISGPQDVEAYKKEGVKAILVGEALMRAPDTSAFVAQLLGGSNQNFAGASPSSPLVKICGTRTEEGALAAIQAGADLIGIIMVQGRSRLVPDDVALGISRVVKSTPRPADTLQQPSSATSLEWFDHSTNILRHPSRALLVGVFMNQPLSYVVSQQQKLGLDVVQLHGSEPLEWSSLIPVPVIRKFAPGDIGIARRAYHTLPLLDSGAGGSGELLEESGVKKVLDSDEGLRVILAGGLNPDNVAGTVKKLGQSGQKVVGLDVSSGVETNGAQDLEKIRAFVKSAKSIRQ

SEQ ID NO: 19601 - protein, 251 aa, Glycine max
  unsure (1)..(251): unsure at all Xaa locations
DIFFQCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPALGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSXDEK

SEQ ID NO: 19602 - protein, 437 aa, Corynebacterium glutamicum ATCC 13032
MTTDKRKTSKTTDTANKAVGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 19603 - protein, 570 aa, Apium graveolens
MATGGDQDVYGEDCAAEDQLVTPWTISVASGYTLLRDPHHNKGLAFTEKERDAHYLRGLLPPAIISQQQQEKKLMQNLRSYEVPLHRYMAMMELQERNERLFYKLLIDNVEELLPVVYTPTVGEACQKYGSIFRRPQGLYISLKEKGKILEVLKNWPEKNIQVIVVTDGERILGLGDLGCQGMGIPVGKLALYTALGGVRPSACLPITIDVGTNNESLLNNEFYIGLKQRRATGKEYADLLQEFMTAVKQNYGEKVLVQFEDFANHNAFELLSKYSTTHLVFNDDIQGTASVVLSGIVSSLKLIGGMLADHTFLFLGAGEAGTGIAELIALEMSKQTKIHLEETRKKIWLVDSKGLIVSHRKESLQHFKKPWAHEHEPCTTLIDAVKAIKPTVLIGTSGQGKTFTKEVVEAMASFNKKPLIMALSNPTSQAECTAEEAYNWSEGRAVFASGSPFDPVKYNNQLYIPGQANNAYIFPGLGLGLVMSGAIRMHDEMLLAASEALACQVTQEHYDKGMTFPPFSNIRTISANIAAKVAAKAYDLGLATRLPRPEDLVKFAESCMYSPNYRIYR

SEQ ID NO: 19604 - protein, 513 aa, Pseudomonas aeruginosa PAO1
MKIRSQVGMVLNLDKCIGCHTCSITCKNVWTSREGMEYAWFNNVETKPGIGYPKEWENQEKWKGGWVRAADGSIRPRIGGKFRVLANIFANPDLPEIDDYYEPFDFDYQHLHTAPKAEHQPVARPRSLVSGQRMEKIEWGPNWEEILGTEFAKRRKDKNFDQVQADIYGEYENTFMMYLPRLCEHCLNPACVASCPSGAIYKREEDGIVLIDQDKCRGWRMCISGCPYKKIYFNWKSGKSEKCIFCYPRIEAGQPTVCSETCVGRIRYLGVLLYDADRIHEVASCENERELYEKQLEIFLDPFDPAVIAQARKDGVADSVIEAAQKSPVYKLAMDWKLALPLHPEYRTLPMVWYVPPLSPIQNAAAEGHIGSDGVIPDVESLRIPVQYLANLLTAGDTAPVLLALKRLLAMRAYKRAEHVEGRQDLEVLAKVGLSVEQVEEMYRYLAIANYEDRFVIPSAHREEALSDAFAERSGCGFSFGNGCSGGSNSAVNLFGGKPTNRRDVIQVVQIQE

SEQ ID NO: 19605 - protein, 291 aa, Zea mays
  unsure (1)..(291): unsure at all Xaa locations
MALSIYTPTSSSLVPPSIQEVRLTSRPPKPATFSLRRPHLAARAAAGNAPTSPVREVVTELDAVAGFSEIVPDTVVFDDFERXPSSCLTLYFFLSCCPIRFGGRVAHCAIVNNHRFAPTAATVSSSLLLGITGLPDTKFKSAIDTALADGECNALEKAEDRMSCYLTKALANVGAELAHQVPGRVSTEIDARLAYDTQGIIHRVHELLNLYNQHDVSTDRLLFKIPATWQGIEASRLLESEGIQTHLTFVYSFAQAAAAAQAGASVVQMFVGRLRDWAKHHSGDPEIDEAL

SEQ ID NO: 19606 - protein, 512 aa, Debaryomyces occidentalis
MRFSTEGFTSKVVAAILAFSRLVSAQPIIFDMRDVSSSADKWKDQSIYQIVTDRFARSDGSTTADCLVSDRKYCGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQNYMKGVTNYPLYYPVYRFFSDTSATSSELTSMISTLQSSCSDVSLLGNFIENHDQVRFPSVTSDTSLIKNDMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVLAGDSGSLSVSISGGMPQVYAPSSVLSGSGICNQ

SEQ ID NO: 19607 - protein, 146 aa, Triticum aestivum
  unsure (1)..(146): unsure at all Xaa locations
MAPTVMASSATSVAPFQGLKSTAGLPVSRRSNGASLGSVSNGGRIRCMQVWPIEGIKKFETLSYLPPLXTEALLKQVDYLIRSKWVPCLEFSKXGFIFREHNASPGYYHGRYWTMWKLPMFRCTHPTQVINEVEEVXKEYPDPYCH

SEQ ID NO: 19608 - protein, 245 aa, Ralstonia metallidurans
MRQKLVIGNWKMHGSLAANAALLEGIKAAPARAKLAVCAPFPYLAQCQTLLSGSQVAWGAQDVSSEARGAFTGEVAASMLGEFGCGYALVGHSERRTYHGETDAVVAAKALRALEFDIVPVVCVGETLAEREAGQTEAVVGRQLQAVLDALSIEQLGRIVLAYEPVWAIGTGKTATSAQAQEVHAALRARVTAKDAGVAARMAILYGGSVKPDNAAELFSMSDIDGGLIGGASLKADDFLAIGNA

SEQ ID NO: 19609 - protein, 286 aa, Glycine max
  unsure (1)..(286): unsure at all Xaa locations
TWFVEVLAATQTPGEAGKKWFQGTADAVRQFIWVFEDAKNKNVEHILILSGDHLYRMDYMDFVQRHVDTNADITVSCVPMDDXGRIIQFAEKPKGSDLKAMRVDTTLLGLLPQEAEKRVSYVGPPPHVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASXVAEGKVPIGVGAN

SEQ ID NO: 19610 - protein, 410 aa, Escherichia coli
  unsure (1)..(410): unsure at all Xaa locations
EFTTGLXSLDTALNEXLSRVTPLTAQETLPLVQCFGRILASDVVSPLDVPGFDNSAXDGYAVRLADIASGQPLPVAGKSFAGQPYHGEWPAGTCIRIXTGAPVPEGCEAVVXQEQTEQXDNGVRFTAEVRSGQNIRRRGEDISAGAVVFPAGTRLTTAELPVIASLGIAEVPVIRKVRVALFSTGDELQLPGQPLGDGQIYDTNRLAVHLXLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLQRNADGELEVTTTGHQGSHIFSSFSLGNCFIVLERDRGNVEVGEWVEVEPFNALFGGL

SEQ ID NO: 19611 - protein, 625 aa, Oryza sativa
MDTASFVTSLLTSFVIFVVLVLVFTWLSSRPGNAPVYYPSVLLRGLDPWEGRGRGTRSPVGWLRQAISASEGDVVAAGGVDAAVYLVFLSSVLLPVAATDDNLNLERAIGLKNGKTPQNFTELEKLALGNVQADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPKIKTVLQAYLPQLALIVFLALLPSLLMFLSKLEGIPSQGHTVRAAAGKYFYFIVFNVFLGVTISSTLFSALTTIINNPPGIVNMLASSLPGSATFFLTFVALKFFVGYGLELSRLVPLIIFHLKRKYLCKTEDEVRAAWAPGDLGYNTRVPNDMLIVTIVLCYSVIAPLIIPFGVAYFALGWIIVKNQVLRVYVPSYESNGRMWPHMHTRIIAALLIYQITMVGVILLKKFLYSPVLVPLIPISFIFAYICHMRFYPAFAKTPLEVVQHNVKDTPNMDAVYTSYIPACLKPEKLEDVDIFEDAQLHTTSRAPSI

SEQ ID NO: 19612 - protein, 417 aa, Zea mays
  unsure (1)..(417): unsure at all Xaa locations
RLSRRSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDXTKVSRPLPWRPATNVFRVKEDVRPIFWANRPKSYLKRTLGWDQYPHGRWGDSRNPSYGALTDHQRFTNFCQGKLTSSPWSELDGLQPETKIIDDQLVNINQKGFLTINSQPAVNGEKSDSPTVGWGGPGGYVYQKAYLEFFCAKEKLDQLIEKIKAFPSLTYIAVNKDGETFSNISPNAVNAVTWGVFPGKEIIQPTVVDHASFMVWKDEAFEIWTRGWGCMFPEGDSSRELLEKVQKTYYLVSLVDNDYVQGDLFAAFKI

SEQ ID NO: 19613 - protein, 73 aa, Zea mays
MDPTKFRPCSRHDTTGTTTNAGAPVWNDNEGLTVGPCGPILVGGYHLSEKVAHFALEGIPERVVHARGATGRG

SEQ ID NO: 19614 - protein, 91 aa, Triticum aestivum
  unsure (1)..(91): unsure at all Xaa locations
MAPTVMASXATSVAPFQGLKSTAGLPVSRRSNGASLXXVSNGGRIRCMQVWPIEGIKKFETLPYLPPLSTXAXLKQVDYLIRSKWXPCLXF

SEQ ID NO: 19615 - protein, 531 aa, Oryza sativa
MAAASSAHYFGLGEPQMQQQQQQPPLQNNAAAPVAATPPPKKKRNQPGNPSKFVCEVCNKGFQREQNLQLHRRGHNLPWKLKQKNPKETRRRVYLCPEPSCVHHDPSRALGDLTGIKKHYSRKHGEKKWKCDKCNKRYAVQSDWKAHSKTCGTREYRCDCGTLFSRRDSFITHRAFCDALAQESGRIMPPMGAALYAAAGAGMAIGGLTGMAASHQLQPFQDHSSAITTAANAAAQFDHLMATSSAAAGSPAFRAAQPTSSSSSPFYLGGGGDDGQAHTSLLHGKPAFHGLMQLPEQQGSNGGGLLNLSYFSGGNGGHHHHHQEGRLVFPDQFNGVAAGNGARAGSGEHGNSGNNADSGSIFSGNMMGGGGGFSSLYSSSDQTVPPPQMSATALLQKAAQMGATTSSGGAGSVNSLLRGLGSGGGGGALNGKPAGAAGFIMSGESSSRSTASQTAENESQLRELMMNTLSATGGGTGAGTVFVGGGFPGVDDGKLSTRDFLGVSGGAPGLQLRHGGAAGMGMAGSLDQEMK

SEQ ID NO: 19616 - protein, 119 aa, Triticum aestivum
MAPTVMASSATSVAPFQGLKSTAGLPVSRRSNGASLGSVINGGRIRCMQVGGVEGLTKFETLSYLPPLSTEALLKQVDYLIRSRWVPCLLFSTVGFIFRVLSASPGFYDGRCWSMWKLP

SEQ ID NO: 19617 - protein, 79 aa, Zea mays
  unsure (1)..(79): unsure at all Xaa locations
FDHTIEINVPMSRFLPFKGTGDFKLAQSDLYTYDDRSVTLNSTLTNPXNTSIEHFPDFNNDWSYLGLXQSIPIIVELDT

SEQ ID NO: 19618 - protein, 477 aa, Schizoseris dichotoma
KNDRYESGVIPYAKMGYWDPEYVIKETDVLALFRVSPQPGVDPVEASAAVAGESSTATWTVVWTDLLTACDLYRAKAYKVEPVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEMKGHYMNVTAATMEEMYERAEFAKQLGTVIIMIDLVIGYTAIQTMGVWARRNDMILHLHRAGNSTYSRQKIHGMNFRVICKWMRMAGVDHIHAGTVVGKLEGDPKMIKGFYDTLLEPFLEVNLPEGIFFTQDWASLRKVTPVASGGIHCGQMHQLLDYLGNDVVLQFGGGTIGHPDGIQAGATANRVALESMVIARNEGIDYVKEGPQILRDAAKTCGPLQTALDLWKDITFNYTSTDTADFVETPTANV

SEQ ID NO: 19619 - protein, 343 aa, Neisseria meningitidis Z2491
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKVHLESGAKKVLISAPGGDDVDATVVYGVNDSILTADMTVVSNASCTTNCLSPVAKVLSESVGIVKGAMTTIHALTNDQTVTDVRHKDLRRARSGVENMIPTKTGAAKAVGLVLPELKDKLDGLAIRVPTVNVSLVDLNFQAARDTTIEEINALMKAASEAGALKGVLGYNTLPLVSMDFNHTTEASHFDATLTKVVDGNMIKVFAWYDNEWGFSCQMLNTARRMFGLEVRPLK

SEQ ID NO: 19620 - protein, 394 aa, Zea mays subsp. mays
LGAERRARLPPGEMGWPLVGGMWAFLRAFKSGKPDAFIASFVRRFGRTGVYRSFMFSSPTVLVTTAEGRKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFL

SEQ ID NO: 19621 - protein, 426 aa, Chlamydophila caviae GPIC
MLVLLIFVLLCGFYTSWNIGANDVANAVGPSVGSGVLTLRQAVIIAAIFEFLGALFLGDRVAGTIESRIVSVSDPLIASGDYIYGMTGALLATGVWLQLASYFGWPVSTTHSIVGAVIGFGLVLGKGTVIYWGSVGTILVSWVISPLMGGCIAYLIFSFIRRNILYKNDPVGAMIRIAPFLAAFVIITLGIIIVCGGVVTRLVPLPLALLLVFLVGSLAYALMFKYVHTSHCSFICESPKPGSLLCRLKTCGGNYGRKYLIVERIFAYLQIIIACFMAFAHGSNDVANAIAPVAGVLRQAYPQVYSSYTLIGLMAFGGVGLIIGLSVWGWRVIETVGCKITELTPSRGFSVGLSAAVTIALASAMGLPISTTHVVVGAVLGIGLARGIHAINLNIIKDIIMSWFITLPAGAILSILFFFALRALFH

SEQ ID NO: 19622 - protein, 304 aa, Bacillus anthracis str. A2012
MMFKLMFAILTPALISGAFAERMRFSAFLIFILLWTTIVYNPVAHWVWGVGGWLRELGALDFAGGNVVHITSGVAGLVLAIFLGKRKNINGTSPHHLPFTMLGAGLLWFGWFGFNVGSALSLNDVALTAFINTNIAAAASALTWMLSEWFFQSKPTAMGAACGAVSGLVAITPACGFVTPFSALLIGAIGGVLCFGAVFFLKTKFGYDDTLDAFGCHGIGGTWGGIATGLFATTTVNGDGANGLFYGNAALLFKQFVAIGATYAFTIIMTYAIIKAINFFLPVRVDEHEEHMGLDISMHGRESL

SEQ ID NO: 19623 - protein, 187 aa, Thujopsis dolabrata
ICTYFAQPLHQRDYSRWPLKPEGWREIVDKYSEALMDLASKMLTIVSEALGLEPDAVTKACVEMDQKVVINYYPKCPEPDMTLGLKRHTDPGTITLLLQDQVGGLQATKDNGLNWITVQPVQGAFVVNLGDHMHYLSNGKFKTADHQAVVNSNYSRLSIATFQNPSQEAIVYPLKLEEGEECFMEEP

SEQ ID NO: 19624 - protein, 78 aa, Triticum aestivum
  unsure (1)..(78): unsure at all Xaa locations
MSGVTADEDKKPAGDGGGAHINLKVKGQDGNEXFFRIKRSTQLKKLMNAYCDRXSVGFNSIAFLFXDGRRSXXEQTPG

SEQ ID NO: 19625 - protein, 491 aa, Bifidobacterium longum DJO10A
MSTTDAPKKPRETDDVPVPATLRKSLKNRHIQLIALGGAIGTGLFYGSSESIALAGPSILLAYLVGGFAIFMIVRALSEMSVEDPKAGAFSYYATRYWSKRAGFISGWNYWFNYILVSMVELSVVGSFVNYWFPAIPTWVSAAVFLVIICAANLLGVSKFGEFEFWFAIIKIVAVIAMIIGGLAVIIFVLPTASGVRASFANWFTVGNGFFPNGLMGQNSDGSWTGLLMALVVVMFSFGGTELIGITAGETEDPKTTIPRATNDIIWRILVFYIGALGVIMAVVPWNTIDGKSSPFVQIFDSVGIHAAAGILNFVCLTAVMSVYNSGLYANSRMLYSLAKQGNAPAYLGKLNSRGVPVAGVLTSAAITAIAVVVVFVWPEFAFNYLMSIATIAGIINWTMIMLTEMKFRKVVAAGGAPEDSELAGLSGQEALDAIHFKLPFAKVTPWVVLAFLALVVVLMCFSTSYRIAVIAGVIWLAILFAAYQLTQAKK

SEQ ID NO: 19626 - protein, 273 aa, Zea mays
MVRKNRANQGSRCLLPSLGLGLGALCKDDSGAMERSTTTTEGHVVGIPVSTRAYGIEEPDFPAEETQTPDRGEFPSSFQYYSHDAASSTTTAADRPTSDQQATRKGDKIVRGIKEHVTLGPKLSDTVKGKLSLGAKILRAGGSVEKLFRQWFSADKDEKLLRASQCHLWTTAGPIAGVLFVSTARVAFRSDRSLSLAVSTPRGDCSFRAPYKVAVPLRKVGAVRPSENRHRPEQRYVRLATTDGFEFWFMGFVSYNKSLQHLERAVACARQAR

SEQ ID NO: 19627 - protein, 423 aa, Xanthomonas campestris pv. campestris str. ATCC 33913
MSTAPQKPLAIRERLSEVRYEIRGELARRARELEAQGRKLIKLNIGNPGAFGFRAPEHLQRAIADDMGRTDPYTHQQGLPEAREAIAAAYARRQHPDAHPDRIFIGNGVSELIDLSLRALLNPGDEVLVPSPDYPLWSAATILNDGRPVYYRCAPENGFQPDPVEIETLVSSRTRAIVLINPNNPSGASYSRELLERIVAIAVKHNLLLMVDEIYDQVLYDGAAFVPVAPLAGEHPCITFSGLSKVHRACGWRVGWALLSGEQSRINDLRNAMDLLGALRLCANVPGQYAIDAAVNGPDTISALCAPGGRLYETRRAVIEACAASSHLSLVAPAGALYAFPAVVGPAARAFDDHTFALDLMNDEGVLVVPGSSFNVPYRHHFRVTLMPEAAVMRDVFARIDRALTRRAEAVTKVVPLKSRSVA

SEQ ID NO: 19628 - protein, 529 aa, Metroxylon sagu
MAATGISRIPLLKTLIPSTSPSPSSDRGSNDLPLCLKPSLNWRLSSSFHFSGEALFSKAVLGSGKTAAGGRTPVLVSPKAVSDSKSSQTCLDPDASRSVLGIILGGGAGTRLYPLTKKRAKPAVPLGANYRLIDIPVSNCLNSNISKIYVLTQFNSASLNRHLSRAYGSNMGGYKNEGFVEVLAAQQSPENPNWFQGTADAVRQYLWLFEEHNVMEFLVLAGDHLYRMDYERFIQAHRETDADITVAALPVDERRATAFGLMKIDEEGRIIEFSEKPKGEQLKAMKVDTTILGLDEERAKEMPYIASMGIYVISKDIMLQLLRDKFPGANDFGSEVIPGATNIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDSLLMGADYYETDQEKRFLAAKGSIPIGIGKNSHIKRAIIDKNARIGENVQIVNNDNVQEAARETDGYFIKSGIVTVIKDALIPSGTLI

SEQ ID NO: 19629 - protein, 161 aa, Glycine max
  unsure (1)..(161): unsure at all Xaa locations
PKPGILFQDITTLLLDPQAFRDTTDLFVERYKDKDITVVAGVEARGFIFGPPIALAIGAKFVPIRKPKKLPGEVISEEYSLEYGTEKIEMHVGAVQPNDRVLIVDDLIATGGTLCAAAKLIERVGAKVVECACVIELPELKGRDKLGDMPVFVLVQADXSV

SEQ ID NO: 19630 - protein, 360 aa, Streptomyces coelicolor A3(2)
MTEAILLVGGKGTRLRPLTVNTPKPMVRAAGVPFLTHQLARAKAAGVEHIVLATSYLAEVFEPYFGDGSTLGLHLEYVTEEEPLGTGGAIRNVASRLHSGPDEPVLIFNGDILTGLDIGALVRTHETTGADVSLHLTQVTDPRAYGLVPTDDTGRVLAFLEKPQTPEEIVTDQINAGAYVFRRSVIDTIPAGRPVSVERETFPELLATGAHLQGMVDSTYWLDLGTPAAFVRGSADLVLGRAPSPAVPGRCGDRLVLPTAQVAPDAKLTGGTVVGEGAFVAEGARVFGSTILPGAVIEPGAVITDSLIGTRARVGTRSVLADTVIGDGAVIGADNELRSGARIWCDAHIPPASLRFSPDT

SEQ ID NO: 19631 - protein, 267 aa, Triticum aestivum
MAARSRARRLLPLLTFVALGMVLGSLLQLAFFRRLDDHSHTGHFDNDQEAADLRLGYVKPEVISWKPRIIVFHNFLSSEECDYLREIARPRLEISTVVDVATGKGVKSDVRTSSGMFVNSEERKFPVIKAIEKRISVFSQIPVENGELIQVLRYEPSQYYRPHHDYFSDTFNLKRGGQRVATMLMYLTDGVEGGETHFSSGRDGGECSCGGRMVRGLCVKPNKGDAVLFWSMGFDGNTDSNSLHSGCAVVKGEKWSATKWMRQKMTF

SEQ ID NO: 19632 - protein, 148 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDLPP

SEQ ID NO: 19633 - protein, 409 aa, Zea mays
MAAALQATPIKTLATSRWRVEGAEARPRPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 19634 - protein, 123 aa, Zea mays
  unsure (1)..(123): unsure at all Xaa locations
LKSNHPFRTIVVNPKGLGDTINLFGERHTDQRITLVADVKTIGFILGPTITLAIGAKFAPLRKPKKLPRDVIYEEYSMEYGTDNIEMYVATVQANHRTLXLNDLIATAQTLCSTVKLIERILT

SEQ ID NO: 19635 - protein, 129 aa, Zea mays
  unsure (1)..(129): unsure at all Xaa locations
VILDVEHAAFSPSHMVPGIDVSNDRMLQGRLFSYPDTHRHXRLGANYLQLPINQPYRARVAHHQRDGPSTFSQNFNGSPNYEPQSVDPSGPVQQLQDVTAKYSPVSLNGTTGRYPHRRSEDDFVQPGNL

SEQ ID NO: 19636 - protein, 374 aa, Oryza sativa
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKSNAGDNNS

SEQ ID NO: 19637 - protein, 335 aa, Oenococcus oeni MCW
MPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 19638 - protein, 517 aa, Staphylococcus epidermidis ATCC 12228
MKIKAQVAMVLNLDKCIGCHTCSVTCKNTWTNRPGAEYMWFNNVETKPGVGYPKRWEDQGQYKGGWVLNKKGKLELKSGNRWSKIALGKIFYNPDMPLIQDYYEPWTYNYEHLTNAKQGQHSPVATAHSLISGDRLNLKWGPNWEDDLAGGHITGPEDPNIQKIEEDIKFQFDETFMMYLPRLCEHCLNPSCVASCPSGAMYKRDEDGIVLVDQEACRGWRYCMTGCPYKKVYFNWKTNKAEKCTFCFPRIEAGMPTVCSETCTGRMRYLGVLLYDADRVQEAASAKDEKDLYEKQLDLFLDPFDEEVIAQAEKDGINQEWITAAQNSPVYKLAIEYKMAFPLHPEFRTMPMVWYCPPLSPIMSYFEGENAGQNPDMIFPAIEEMRLPIQYLANLLTAGDTKPVKEGLQKMAMMRSYMRSQITNQPFDTSKLERLGLTERQMTEMYRLLGIAKYEDRFVVPSSHKETYLDTYKAQGSQGYGGEYFGSNCEGCGVAVQSGKTGQEIYNENFYGGIFRD

SEQ ID NO: 19639 - protein, 364 aa, Salmonella typhimurium LT2
MALFNSAHGGNIREAATVLGISPDQLLDFSANINPLGMPVSVKRALIDNLDCIERYPDADYFHLHQALARHHQVPASWILAGNGETESIFTVASGLKPRRAMIVTPGFAEYGRALAQSGCEIRRWSLREADGWQLTDAILEALTPDLDCLFLCTPNNPTGLLPERPLLQAIADRCKSLNINLILDEAFIDFIPHETGFIPALKDNPHIWVLRSLTKFYAIPGLRLGYLVNSDDAAMARMRRQQMPWSVNALAALAGEVALQDSAWQQATWHWLREEGARFYQALCQLPLLTVYPGRANYLLLRCEREDIDLQRRLLTQRILIRSCANYPGLDSRYYRVAIRSAAQNERLLAALRNVLTGIAPAD

SEQ ID NO: 19640 - protein, 122 aa, Triticum aestivum
GETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 19641 - protein, 468 aa, Phyllariopsis brevipes subsp. pseudopurpurascens
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPPTGVVVERERLDKFGRPLLGATVKPKLGLSGKNYGRIVYEGLTGGLDFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVSEGPEILRNAARTCGPLKAALDLWKDITFDYTSTDTPDFVEVPTESN

SEQ ID NO: 19642 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 19643 - protein, 333 aa, Corynebacterium efficiens YS-314
MQPDTTGQGTVDSLDPMSETSPESTSVSKIAVITTGGTIACTADADGHLLPTVSGEELLRPIAARFDASQFTFEIHELNRLDSSSMTFADIDELNTRIHQVLEDPEVVGVVVTHGTDSMEETAVAVDTFHTDHRPVIFTGAQKPADHPEADGPGNLFEACLIASDASARGIGVLVVFGHAVIPARGCTKWHTTDELAFATNGPEEPERPDPLQLAPLADVTVEIIPAYPGASGASVQAALDAGAQGLVVEAMGSGNVGTAMGAALGRALDDGIPVVMTTRVPRGEVSGTYGGAGGGATLAARGAIGSRYFRAGQARVLLAAAIATGQHPATLF

SEQ ID NO: 19644 - protein, 466 aa, Escherichia coli
MGQSSQPHELGGGLKSRHVTMLSIAGVIGASLFVGSSVAIAEAGPAVLLAYLFAGLLVVMIMRMLAEMAVARPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIGKILRAEGSEIRLRMWLYPWLTWLVIGFITFVLVVMLFRPAQQLEVISTGLLAIGIICTVPIMARWKKLVLWQKTPVHNTR

SEQ ID NO: 19645 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALTVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 19646 - protein, 497 aa, Burkholderia fungorum
MADIRILSEVETFLARQHRQYIDGQAVAAMDTVATDIINPSNRKVVASVRQATPAQVQHAVASAHEAFTGVWQQTSAARRGELLNRLADLMQAHREELAQIESLSSGKLIGLSRAFEIDYSIAFLRYYAGWATKIHGQTMNLSLPSSNGEQYTGFTLRQPIGVVAGIVPWNFSIMIAVWKFGSALACGCTAVIKPSEFTPLTMLRVAELALEAGIPPGVLNIVNGNGRTVGTALIAHPKVAKVTFTGSVPTGVGVGVAAMQAGLKHVTLELGGKNPAGFLRDFPVERTVDGIIEAAYLHQGEVCASAERFYVHRSRIDDVLEALHHTLATLKIGSALDESAQFGPLANAAHFAKVMAFFEKARAQDGEIVHGGTVAPGDGFFVQPTAIPARSQADTIMTEETFGPVASFLAYDDEEEMLHYMNDTHFGLTASIWTNDLSKALRFVPRVEAGTVWVNMHNYIDPAMPFGGVKSSGIGREFGEAFIEYFTELKSVIVRY

SEQ ID NO: 19647 - protein, 328 aa, Zea mays
MSFGSVGMEEEGGAAAAAEEIRRLPAEVNWEMLDKSRFFVLGAALFSGVSAALYPAVVVKTHLQVAPPPQAARATAAAILRRDGLRGFYRGLGASLGGTVPARALYMAALEATKSSVGSAAVRLGVSEPAASAAASAAAGVSAAVAAQVVWTPVDVISQRLMVQTPDACRYRGGADAFRKILLADGVRGLYRGFGLSILTYAPSNAVWWSTYAVAQRCLWRAVGTERSESCACLMAVQGASAALAGGTAALVTMPLDTVKTRLQVMEADAAARPTLASTVRGLLREGGWAACYRGLVPRWGSMSLSAATMVTTYEFLKRLSAKDGSLG

SEQ ID NO: 19648 - protein, 211 aa, Zea mays
  unsure (1)..(211): unsure at all Xaa locations
MAGTEVEDPPAAALEVPAKRGLLRYNSPLAQVSLLGLICFCCPGMFNALSGLGGGGQVDPTIADNANTALYACFAVFGVLGGAAHNLLGPRATLLAGALTYPLYAGSFLYYNHRPGSQVFPVTAGALLGAGAGFLWAAQGAVMTSYPPPNRRGTYISLFWCLFNLXGGVLGGLLPFALNYNRGDKKGSVSDGTYIGFMAFMLVGAALTVLV

SEQ ID NO: 19649 - protein, 541 aa, GIBBERELLA ZEAE PH-1
MAPHAEVGTGSSNGSVYNGRGSSATQDLFTVNSPNVTYTDAEIRSRYTYRTTKVEVDASGKYVATPNETLYDFKVDRKVPKVGMMLVGLGGNNGTTVTAGILANRRQLAWDTKEGPRESNYYGSVVMGSTLKLGHDAKTHQEVNIPFHNILPMVHPNDLVIGGWDISKMNLAQAMDRAQVLEPTLKAQVKKEMAEMVPLPSIYYPDFIAANQEDRADNVLEGTKACWEHVEKIRQDIRDFKAKNSLDKVIIMWTANTERYADLIEGINDTADNLLKAIEQGHEEVSPSTVFAVACILEQAPFINGSPQNTFVPGAIELAEKHNAFIGGDDFKSGQTKMKSALVDFLINAGIKLTSIASYNHLGNNDGKNLSSQKQFRSKEISKSNVVDDMVEANHVLYKKGEHPDHCVVIKYMPAVADNKRALDEYYAEIFMGGHQTISLFNICEDSLLASPLIIDLVIIAEMMSRIQWKAVSSDGTATTEYKSFHSVLSVLSYMLKAPLTPPGTPVVNALAKQRAALTNIFRACVGLEPESDMTLEHKLF

SEQ ID NO: 19650 - protein, 229 aa, Triticum aestivum
  unsure (1)..(229): unsure at all Xaa locations
MRKSSCGHVIGVPVTSKAYALEEATTRGAGAAKKDGDRLAVSLTHPSPYASFGYKHSSKGQVIHWVNKLGRRAQGFRDHVTLGPKLSETVKGKLSLGARILQAGGVERVFRQAFSAEKGERLVKALQCYLYTTSGPIAGMLFVSTRKIAFRSDRSLTVTSPAGDVARVPYKVVVPLGRIKGVQPSENADNPEQKYIHMAPVDGFEFWFMGFVSXXRXCKYMQQVISSQP

SEQ ID NO: 19651 - protein, 179 aa, Coprinopsis cinerea
MMTSRALGLGSALRTAAFTPRTLRNQVVLRNSITRRFVQTESLTPAENLQLLNKQRLKRPSSPHFTIYQPQLTWLGSIANRVTGAGLSVLLYGFSIAYLIAPGTFDSAHVVEFVAGLPDGVKYAGKAILAAPFSYHAWNGLRHLAWDAGKFLSVKGAYATGYAVLGLTGVSTVVLTFFK

SEQ ID NO: 19652 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGPEVIELAKTNWLR

SEQ ID NO: 19653 - protein, 356 aa, Verticillium fungicola
MSRANPPNNASASRKISFNVSEQYDIQDVVGEGAYGVVCSAIHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 19654 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEPEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 19655 - protein, 376 aa, Eremothecium gossypii
MSTAELDASKLKVIRKEEPTVFEQNADFTFGRLFIDHMLVVEWKRESGWQAPEIRPYGNLSLDPSACVFHYGFELFEGMKAYRTEDGRVTLFRPEMNAARMNRSAARIGLPQFDAEQLVELIGKLVELDRQFVPQRPGYSLYIRPVMIGTSASLGVTAPDSALLYVIACPVGPYYKSGFSAVRLLATDNVTRAWPGGFGDKKLGGNYAPCIPSQEEAARLGYHQNLWLFGPEKYITEVGTMNAFFVFKDSTTGKKELVTAPLDGTILEGVTRDSVLTLARERLSPEEWDVSERYYTISEVAERAAKGEVVEAFGCGTAVVVSPIKEIGWNDQAIKIPLLPGEETGEFTKQVAHWISEIQYGKVEYNNWSRTIADLK

SEQ ID NO: 19656 - protein, 190 aa, Desulfovibrio desulfuricans G20
MRRGRPRTDARRTGALRYIRRRSFTSGALRGYQQGRAGRGGSMSRYRLKLNKKRCIHCKACEVHCKAKNNTPAGIKLGVHTSSEPVMVDGVPRMKAAYQCCYHCETPECVDVCPTGAMIRRESDGIVYVDQETCIGCEACIDACPWHIPVFNAATATVLKCDFCMDRVDEGKLPACVTACTTHALSFTRK

SEQ ID NO: 19657 - protein, 539 aa, Oryza sativa
  unsure (1)..(539): unsure at all Xaa locations
MAGELKVLNALDSAKTQWYHFTAIVIAGMGFFTDAYDLFSISLVTKLLGRIYYFNPASKSPGSLPPNVSAAVNGVAFCGTLAGQLFFGWLGDKMGRKKVYGMTLMLMVICCLASGLSFGSSAKGVMATLCFFRFWLGFGIGGDYPLSATIMSEYANKRTRGAFIAAVFAMQGFGNLTGGIVAIIVSAAFKARFDAPAYRDDRAGSTVPQADYAWRIVLMLGAIPALLTYYWRMKMPETARYTALVAKNAKQAAADMTQVLNVEIVEEQEKADEVARREQFGLFSRQFLRRHGRHLLGTTVCWFVLDIAFYSSNLFQKDIYTAVQWLPKADTMSALEEMFKISRAQTLVALCGTIPGYWFTVFFIDIIGRFVIQLGGFFFMTAFMLGLAVPYHHWTTPGNHIXGFVVMYAFTFFFANFGPNSTTFIVPAEIFPARLRSTCHGISAAAGKAGAIVGSFGFLYAAQSTDASKTDAGYPPGIGVRNSLFFLAGCNVIGFFFTFLVPESKGKSLEELSGENEDDDDVPEAPSTADHRTAPAPPA

SEQ ID NO: 19658 - protein, 234 aa, Solanum tuberosum
MAREKIKIKKIDNITARQVTFSKRRRGLFKKAEELSVLCDADVALIIFSSTGKLFDFASTSMKDILGKYKLQSASLEKVDEPSLDLQLENSLNMRLSKQVADKTRELRQMRGEELEGLSLEELQQIEKRLEAGFNRVLEIKGTRIMDEITNLQRKGAELMEENKQLKHKMEIMKGKLPLLTDMVMEEGQSSESIITTNNPDQDDSSNASLKLGGTTAVEDDCSITSLKLGLPFS

SEQ ID NO: 19659 - protein, 229 aa, Streptococcus mutans UA159
MNNNTIYTQSDSRLSSFFAKIYGLVGMGIGLSAVVSYLMLYVFRNNMIAIMVNAPWVYYVAIFAELALVLIASNAARKNSPTALPLFLVYSALNGFTLSFIIALYTQTTVLQAFVSSAAVFFVMALIGVTIKKDLSGMGKALLAALIGIIIASLINMFIGSGTMSYVISIISVLIFSGLIAYDNQLIKRVYDYNSGNVSDGWAVSMALNLYLDFINLFLSLLRIFGRND

SEQ ID NO: 19660 - protein, 513 aa, Hordeum vulgare
MAMAAAASPSKILIPPHRASAVTAAASTSCDSLRLLCAPRGRPGPRGLVARPVPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 19661 - protein, 249 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 19662 - protein, 337 aa, Petroselinum crispum
ILSPFKFSRRATGDNDVRFKVLYCGVCHSDLHMVKNEWGMTTYPIVPGHEIVGRVTEVGSKVEKFKVGDAVGVGCLVGSCLSCENCDDDSENNCAKQVQTYAFTNVDGSITYGGYADSMVADQHFVLRWPENLPLDSGAPLLCAGITTYSPLRYHGLDKPGTKVGVVGLGGLGHVAVKMAKAFGAHVTVISTSESKKQEALEKLGADEFLVSSDSDQMQAATGTLHGIIDTVSALHPVVPLLGLLKVNGKLVMVGAPEKPLELPVFPLLMGRKVLAGSNIGGLKETQEMLDFAAQHNITADVEVIPVDYVNTAMERLVKSDVRYRFVIDVANTIKTE

SEQ ID NO: 19663 - protein, 265 aa, Klebsiella pneumoniae
  unsure (1)..(265): unsure at all Xaa locations
MMTPIWLGTSWKMNKPLSQAMAWCETLAARMPEGCHPAIQPFVIPSFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGXVTLQNAVELLRQQEINGLFIGRAAWDAQGYCDIVQRVTQEFILQAQ

SEQ ID NO: 19664 - protein, 250 aa, Zea mays; identical to SEQ ID NO: 4092

SEQ ID NO: 19665 - protein, 118 aa, Zea mays
  unsure (1)..(118): unsure at all Xaa locations
TSTEAGAGEEXKKPAEGGAHXNXKGQGTGGXEXXXRXKRXTQXKKGRSAXXDRQXXDXXAXAXRXEGRRXRGEQTXXEXEXEDGDENDARXHQTGGSASTTKKQQRRSGRTKQKGKKE

SEQ ID NO: 19666 - protein, 267 aa, Glycine max
HASADAWAQICACDCFRHRWTGRYEAHLWDKNCWNESQSKKGRQGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAIEYRGLNAVTNFDLSRYINWPRPKTEENHQTIPSNENVNSNAELELGSASDEITEEGVAPSSESNPSRRTFPEDIQTIFENQDSGIYTENDDIIFGDLGSFGAPIFHYELDV

SEQ ID NO: 19667 - protein, 178 aa, Triticum aestivum
  unsure (1)..(178): unsure at all Xaa locations
MAPTVMASSATSVAPFQGLKSTAGLPVSRRSNGASLGSVSNGGRIRCMQVWPIEGIKKFETLSYLPPLSTEALLKQVDYLIXRSKWXVPCLEFNKVGFIFPWSTTHPLGYYDGRLLGQCWKLPMFGVQPDATQVITSGGVKKDYXDAYFRIIGSTTSPSAMLTHASTAQDRKANSIHI

SEQ ID NO: 19668 - protein, 215 aa, Heliobacillus mobilis
MRFFLDSANIDEIREANALGVISGVTTNPSLIAKEGRNFRQVVEEIVAIVDGPISAEVISTDAEGMVAEARELAQIHKNIVIKIPMCAEGLKATSRLSREKIRTNVTLIFSANQGLLAANAGATFVSPFVGRLDDVGHDGLDVIREMVEIFDIHGLATEIIAASVRHPLHVTAAARAGAPIATIPYKVLMQMVKHPLTDKGIEQFLKDWETVKNK

SEQ ID NO: 19669 - protein, 596 aa, Neurospora crassa
MAAYGSRGGDSFGQGSSWSFREPFAVGRVPTWARARHRQEPRLRTFLDSFKRDPVRRISTHGIYAQSHPDQYQAADSSDEPPTEQNHGSHYFDLHAANVRTANTGLARELKGRHLQMIAIGGSVALGELAVAFPVAGSFSSYSTRFLDPAWGFAMGWNYALQWLTVLPLELIAASITIGYWNDQLNKAIFITIFLATVIIINLFGVKGYGEAEFVFSIVKIAAVTGFIILAAVINIGGFDDPQGNTGYIGGRYWTNPGAFHHGFKGLCSVFVSAAFAFTGTELVGLAAAETANPRKSLPTAIKQVFWRITLFYIVSLTLVGLIVPYNHERLLGNIQHYSVSDASYSPFVIAIESASIQVLPGIMNAVILIAVLSVGNSAVFGSSRTLAALADQRQAPQILAYVDRKGRPLFAILFAALVGLIGYLADLKFQSDVLNWLLAVSGLSSIFTWGSICLCHIRFRRAWARRGRSLTQLSFTAQAGITGSYVGLFLNVFVLIAQFWIAAFPIVTFTDNQSAATASPSKVAQSFFLQYLCVPIVVAFYLVYKLWFRTKIVRSDEMDLDTGRRRDVNLPVLVMREKEEVEGWPGWKRVYRFFC

SEQ ID NO: 19670 - protein, 536 aa, Gossypium arboreum
MLQIAFSSYSWLLTASNQKDGMLFPVALSFLVAILGISLWHVWTIRKPKKDIAPLPPGPRGLPIVGYLPYLGTDNLHLVFTDLAAAYGPIYKLWLGNKLCVVISSAPLAKEVVRDNDITFSERDPPVCAKIITFGLNDIVFDSYSSPDWRMKRKVLVREMLSHSSIKACYGLRREQVLKGVQNVAQSAGKPIDFGETAFLTSINAMMSMLWGGKQGGERKGADVWGQFRDLITELMVILGKPNVSDIFPVLARFDIQGLEKEMTKIVNSFDKLFNSMIEERENFSNKLSKEDGNTETKDFLQLLLDLKQKNDSGISITMNQVKALLMDIVVGGTDTTSTMMEWTMAELIANPEAMKKVKQEIDDVVGSDGAVDETHLPKLRYLDAAVKETFRLHPPMPLLVPRCPGDSSNVGGYSVPKGTRVFLNIWCIQRDPQLWENPLEFKPERFLTDHEKLDYLGNDSRYMPFGSGRRMCAGVSLGEKMLYSSLAAMIHAYDWNLADGEENDLIGLFGIIMKKKKPLILVPTPRPSNLQHYMK

SEQ ID NO: 19671 - protein, 590 aa, Bifidobacterium animalis
MVDVSVTATSSDQNLTDSPHYLAETLIKNGVKHMYGVVGIPVTDFARIAQGMGIRFIGMRHEEDAVNAAAAEGFLTGRPAVALTVSAPGFLNGLAPLLEATTNGFPVIMIGGSSTRHVVDMHEGEYEGLDQMNYAKQFCKESFRIDKIEDIPLAVARAMHIACSGRPGGVYIDFPDDAVAQTLDKDVAESQLWVANQPAPAMPPAQSSVDEALKLLSEAKNPLMLVGKGAALAQAEDELREFVEKTDMPFQPMSMAKGVIPDDDPHCTASCRGLALRTADVVLLVGARLNWMLNFGEGKEWNPNVKFIQIDIDPNEIENARSIACPVVGDIKSAMQMINAGLEKTPVKASAQWLDMLKADAEKNDAKFAARVNSNTVPMGHYDALGAIKKVYDQHKDMILTNEGANTLDDCRNIIDIYQPRHRLDCGTWGVMGCAVGYSIGAAVATGKPVLYVGGDSGFGFDGMEVEVACRYNLPITFVVLNNGGIYRGDFENLGDDGDPSPLTLSYDAHYERMIEAFGGNGYYATTPAEVEQMVGEAVASGKPSLVHVQLADYAGKESGHISNLNPKPVVGPLATSEMTANPYLKGAHM

SEQ ID NO: 19672 - protein, 483 aa, Streptomyces avermitilis MA-4680
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 19673 - protein, 723 aa, Schizosaccharomyces pombe
MSKRLTPIHLPNSLNYPIEIASCLVPQGSYVKKGTPLLLYRFFTKVKEDQEDGSEVYVDREFVEQFECPVEGELVEWAVKKEESIENFSKIVAKLHEPCTHEVNYGGLCAICGKNITSQDYMGYSDMARANISMTHNTGDLTVSLEEASRLESENVKRLRQEKRLSLIVDLDQTIIHATVDPTVGEWMSDPGNVNYDVLRDVRSFNLQEGPSGYTSCYYIKFRPGLAQFLQKISELYELHIYTMGTKAYAKEVAKIIDPTGKLFQDRVLSRDDSGSLAQKSLRRLFPCDTSMVVVIDDRGDVWDWNPNLIKVVPYEFFVGIGDINSNFLAKSTPLPEQEQLIPLEIPKDEPDSVDEINEENEETPEYDSSNSSYAQDSSTIPEKTLLKDTFLQNREALEEQNKERVTALELQKSERPLAKQQNALLEDEGKPTPSHTLLHNRDHELERLEKVLKDIHAVYYEEENDISSRSGNHKHANVGLIIPKMKQKVLKGCRLLFSGVIPLGVDVLSSDIAKWAMSFGAEVVLDFSVPPTHLIAAKIRTEKVKKAVSMGNIKVVKLNWLTESLSQWKRLPESDYLLYPSYDLPDRNLSEHSYSSSSDDEQRISELNDRELDEIDWQAADQDVENALKDLSDDNDFDTGSISASQSQPEALEVNTPIKRKADLIQPSYNYDGEKRRKENDNHEGYDLLPNSSTKGEESAENENELDDLADIMEAELSKDTA

SEQ ID NO: 19674 - protein, 614 aa, Lycopersicon esculentum
MPAWWGKKSTKNKDLQAKEKEREKYVKPRSFDELLSRNSPRTSKDFSGSGSGFSGFDSGSSLEKAHPLPMPSVSSLGNDHGVVLGCGSVSVSSTSSSGSSDGGGPVNTDQAQLDTFRGLGDNRLSPLSRSPVRSRGTTTTSSPLHPRFSSLNLDSSTGKLDDVRSECHQLPLPPGSPPSPSALPNPRPCVVAEGANVNMSKWKKGRLLGRGTFGHVYLGFNRENGQMCAIKEVKVVSDDQTSKECLKQLNQEIILLSNLTHPNIVRYHGSELDEETLSVYLEYVSGGSIHKLLQEYGPFREPVIQNYTRQILSGLSFLHARNTVHRDIKGANILVDPNGEIKLADFGMAKHITSCASVLSFKGSPYWMAPEVVMNTSGYGLAVDIWSLGCTILEMATSKPPWSQYEGVAAIFKIGNSKDFPEIPEHLSNDAKSFIRSCLQREPSLRPTASKLLEHPFVKNQSTAKVAHVGVTKESYLRSFDGSRTPPVLELHPGGRTISPGRNISPAEGNYASHPVITVSRPLICARENVKAITSLPVSPTSSPLRQYEPARKSCYLSPPHSSYGIGGQSGYEANDYSMFQTRPSTRITLEPWLEIPHFRTQTPSRSPKTRPIL

SEQ ID NO: 19675 - protein, 467 aa, Streptomyces aureofaciens
MPTPEAGSASGREAVRFPVVDPATGETFDEAPDQQPGELDDVVARAQRAWHGWRADPAARTAALRGAADAVETAGDDLARLLTREQGKPLAESYAEIARTAARLRYFADLAPRTRRIDDGRPVHSEVRWRPLGPVAAIVPWNFPLQLAAAKFAPALAAGNTVVLKPSPFTPLATRMLGSVLATALPEDVLTVVTGREPLGARLASHPGIRHVTFTGSVPTGRAVAGAAAASLARVTLELGGNDAALLLDDVDVDRIADRLFWAAFRNCGQVCMAVKRVYVPARLHAEVVEALAQRAKTVAVGPGLDPGTRLGPVNNARQLARVEQVTEQALADGARAAWGGHRLDGPGYFFAPTILTDVLPGSPVVTEEQFGPVLPVLPYRSLDEAVDAANSTGFGLGGSVWGTDLDQAETVADRLECGTAWINHHAELSLAQPFAGVKDSGVGVAGGPWGLYGNLRPFVVHRPQEV

SEQ ID NO: 19676 - protein, 194 aa, Glycine max; identical to SEQ ID NO: 2198

SEQ ID NO: 19677 - protein, 452 aa, Zea mays
MPQYQELPCGGQELDIDTALKDGILGGALEPVGAAAGDDGKQPVELRRMMDELDAAAVPAVFICPISLEPMVDPVTLCTGQTYERANISRWLALGHRTCPTTMQELWDDALTPNATLRQLIAAWFSRRYTRFKKRSADFHGRAADLVGSLRGTAVPRRQPLKGQARVAALRELRTLAAAHQSVTKAIAEAGGVALLTSLLGPFTSHAVGAEAVAILVSGVLLDADTKAALMQPAKVSLVVDMLNEGAADTKINCVRLIRILMVERGFRPETVASLSLLVGVMRLIRDKRHPDGVAAGLELLNSICAVHRPARCMVVSIGAVPQLVELLPELATECVEPALDILDALSAVPEGRMALKDCPRTIPNAVRLLMRVSEACTRRALSMLWTVCRMAPEECAPAAVEAGLAAKLLLVIQSGCAPELKQKASELLKLCRLNYTDTLFISKCKLTRTIQ

SEQ ID NO: 19678 - protein, 632 aa, Helicobacter pylori J99
MKPTNEPKKPFFQSPIVLAVLGGILLIFFLRSFNSDGSFSDNFLASSTKNVSYHEIKQLISNNEVENVSIGQTLIKASHKEGNNRVIYIAKRVPDLTLVPLLDEKKINYSGFSESNFFTDMLGWLMPILVILGLWMFMANRMQKNMGGGIFGMGSAKKLINAEKPNVRFNDMAGNEEAKEEVVEIVDFLKYPERYANLGAKIPKGVLLVGPPGTGKTLLAKAVAGEAHVPFFSMGGSSFIEMFVGLGASRVRDLFETAKKQAPSIIFIDEIDAIGKSRAAGGMISGNDEREQTLNQLLAEMDGFGSENAPVIVLAATNRPEILDPALMRPGRFDRQVLVDKPDFNGRVEILKVHIKGVKLANDVNLQEVAKLTAGLAGADLANIINEAALLAGRNNQKEVKQQHLKEAVERGIAGLEKKSRRISPKEKKIVAYHESGHAVISEMTKGSTRVNKVSIIPRGMAALGYTLNTPEENKYLMQKHELIAEIDVLLGGRAAEEVFLEEISTGASNDLERATDIIKGMVSYYGMSSVSGLMVLEKQRNAFLGGGYGSSREFSEKTAEEMDLFIKNLLEERYQHVKQTLSDYREAIEIMVKELFDKEVITGERVREIISEYEAANNLESRLIPLEEQAS

SEQ ID NO: 19679 - protein, 205 aa, Solanum tuberosum
LHHFCDPPAIHGDIKPSNILLDDNFNAKIGDFGLARLKAEDHIEIEVRKESPVGNAAEDNGSVAEETESVITVNCLDEFHRGIEQSPESFVRLEASPETVTGVELSPEAPVVSPRTVAAMASPSEGLEKTSLSEGNFDRSSIDSGIEIGNKKSGVKKKKKSITGKDWWWKQDTGGTDSGVVKDYVMEWIGSEIKKERPKTEWVGA

SEQ ID NO: 19680 - protein, 316 aa, Shigella flexneri 2a str. 2457T
MNELDGIKQFTTVVADSCDIESIRHYHPQDATTNPSLLLKAAGLSQYEHLIDDAIAWGKKNGKTQEQQVVAACDKLAVNFGAEILKIVPGCVSTEVDARLSFDKEKSIEKARHLVDLYQQQGVEKSRILIKLASTWEGIRAAEELEKEGINCNLTLLFSFTQARACAEAGVFLISPFVGRIYDWYQARKPMDPYVVEEDPGVKSVRNIYDYYKQHHYETIVMGASFRRTEQILALTGCDRLTIAPNLLKELQEKVSPVVRKLIPPSQTFPRPAPMSEAEFRWEHNQDAMAVEKLSEGIRLFAVDQRKLEDLLAAKL

SEQ ID NO: 19681 - protein, 231 aa, Abies holophylla
RNKGPEDVILRVIYCGICHTNLVEMRNKMGTSHYPMVPGHEVVGIVTEMGSEVKKFKVGEHVGVGRIVGSCGKCCNCNESMEQYCSKRIWTYNDVYHDGSRTQGGFASTMVVDQRFVVRIPENLPLEQAAPLLCAGVTVYSPMKHFGMTEAGKRCGILGLGGLGHMGVKFAKAFGLHVTVISSSDKKKEEALEILGADAYLVTEDAEKMQEAAESLDFIIDTIPVTHPLEP

SEQ ID NO: 19682 - protein, 170 aa, Zea mays
FGSRKNPRGIFISPGPGEPQDSGISLQTVLELGPTIPIFGVCMGLQCIGEAFGGKIIRAPSGVMHGKSSPVYYDEEFPPPELGKALFNGLPNPFTAARYHSLVVEKETFPHDALEATAWTEDGLIMAARHKKYKHIQGVQFHPESIITPEGKKIILNFVRFIEELEKQRS

SEQ ID NO: 19683 - protein, 192 aa, Triticum aestivum
MCPLGQDEEDVPGVAFGYIHKGLRLGTSEMDRLRGSEVKNLLRERKLVLILDLDHTLINSTRLHDISAAEMDLGIQSAASKNDPDGSLFTLQGMHMLTKLRPFVRKFLEEASSMFELYIYTMGDKAYAVEIAKLLDPGNVYFDSKVISNSDCTQRHQKGLDVVLGADSVAVILDDTEYVWQKHKENLILMER

SEQ ID NO: 19684 - protein, 539 aa, Pseudomonas syringae pv. tomato str. DC3000
MKLLAVRRLFRIQRVVIRYRLDDLLFALPLPWWMLAVRFVLPWRWLPRRKSELSRGVRFRLALQDLGPIFIKFGQLLSTRRDLLPEDIADELMLLQDRVPPFDQQVAIKLIEEQLGARICDVFSRFDETPLASASVAQVHAACLKTGEEVVVKVVRPGLKPIIGQDLAWLFILARMAERVSADARLLHPVQVVMDYEKTIYDELDLLREAANSSQLRRNFEGSDLLYVPQVYWDWCRPKVLVMERIYGLQVTDMAGLADQRTDMKMLAERGVEIFFTQIFRDSFFHADMHPGNIFVSTVNPWAPKYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPELDLWSTAQPYLERWMRERVSPKTLLGNLQSQVEQLPHIAGMTRDLLERMSRPHASDPPRPWHDRKDEPVLRLIGAALLVGGAIQGWVMSEAATQLLTLTAWPAAIMLIAGLYLIVRR

SEQ ID NO: 19685 - protein, 199 aa, Yersinia intermedia
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 19686 - protein, 404 aa, Triticum aestivum; identical to SEQ ID NO: 12401

SEQ ID NO: 19687 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 19688 - protein, 526 aa, Candida maltosa
MTSDSTIHELIQSYITKWYVIVPLAIIIYKVFDYFYVLSLRKRLGAAVPTNEETDGYFGFHLPFVLMSKKKDGTIIDFSIERYPELKHPETPTFEFPIFTVKLISTIDPENIKAILATQFSDFSLGTRHAHFAPLIGDGIFTLDGAGWKHSRAMLRPQFAREQVGHVKLLEPHVQVLFKHIRKNKGREFDLQELFFRFTVDSATEFLFGESVESLRDASIGMTSKSKDVDGIEDFTGAFNYSQNYLASRSIMQQFYWILNGKKFRECNAIVHKFADHYVQKALNLTEADLEKQAGYVFLYELVKQTRDPQVLRDQLLNILVAGRDTTAGLLSFVFFELARNPDVVAKLKDEIDTKFGLGEDARIEEITFESLKQCEYLKAVLNECLRLYPSVPQNFRVATKNTTLPRGGGKDGLSPILVRKGQTVMYSVYATHRMESVYGKDATTFRPERWFEPETRKLGWAFVPFNGGPRICLGQQFALTEASYVTVRLLQEFSTLTLDPNLEYPPKKMSHLTMSLFDGTNVQMY

SEQ ID NO: 19689 - protein, 787 aa, Zea mays
  unsure (1)..(787): unsure at all Xaa locations
MQPDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKSWDNIREAKEAYASSGRQQEQANRQDQLSSQFASKAQVGPTPALIKAEVPWSARRGNLSEKERVLKTVKGILNKLTPEKFDLLKGQLMEAGITTADILKDVISLIFEKAVFEPTFCPMYAQLCSDLNEKLPTFPSEEPGGKEITFKRVILNNCQEAFEGASNLRAEISKLTGPDQGMERRDKERLVKLRTLGNIRLIGELLKQKMVPEKIVHHIVMELLGSGTDKKPCPEEEDVEAICHFFNTIGKQLDENPKSRRINDTYFIQMKELTMNPQLAPRLRFMVRDVIDLRSNNWVPRREEIKAKKISEIHSEAEKNLGLRPGAASGIRNGRSSPGGALLPGGAFPMNRPGTGGMMPGMPGSRKMPGMPGLDNDNWEVARSKSMPRGDSIRNQGPLLNKPSTVHKTSSINTRLLPQGSGAGLIGKSALLGTGAPPSRPLSFTPGPTPAQTTPKPIRAAPAVVPAPDKQASAPKGNTAELQKKTIALLEEYFGIRILDEAHQCIVELQSPDYYPEIVKEAVNLALDKGTNFVDPLVRLLEHLYTKKIFKXLKDLESGCLLXGTLLDDIGIDLPKAPAXLGEIIARLTLLGALRFEALEVILKKMEDTYNRKAVSNAFMKTLEANPSGQAILGSPAAAAVIDACNSLLE

SEQ ID NO: 19690 - protein, 224 aa, Oryza sativa
  unsure (1)..(224): unsure at all Xaa locations
MTQVSKVTGSHVPNVMVTKSPILLEDYHLIEKLAQFDRERIPERVVHARGASAKGFFEVTHDISHLTCADFLRAPGVQTPVIVRFSTVVHERGSPETLRDPRGLLSSFTLERHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRXVLNKNI

SEQ ID NO: 19691 - protein, 241 aa, Glycine max
  unsure (1)..(241): unsure at all Xaa locations
KWFQGTADAVRQFIWVFEDAKNKNVEHILILSGDHLYRMDYMNFVQRHVDTNADITVSCVPMDDSRASDYGLMKIDKTGRIIQFAEKPKGSDLKAMRVDTTLLGLSPQEAEKYPYIASMGVYVFRTETLLQLLRWKGSSCNDFGSEIIPSAVNEHNVQAYLFNDYWEDIGTIKSFFDANLALTEQPPKFEFYDPKTPFFTSPRFLPPTKVXKCKIGDAIISHGCFLRECRVQHSIGGVRSR

SEQ ID NO: 19692 - protein, 301 aa, Solanum tuberosum
MNKGATGNQQLELPAGFRFHPTDDELVQHYLCRKCAGQPIAVSIITEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETASFGEFDEEIKPKILPTQLAQMPPRPRSTPTNDYFHFESSESMTRMHTTNSSSGSEHVLSPCDKEVQSAPKWDEDHRNTLDFQLNYLDGLLNEPFETQMQQQSCNFDQFNNFQDMFFYMQKPY

SEQ ID NO: 19693 - protein, 360 aa, Cytophaga hutchinsonii
MEKKIAVLKGDGIGPEVTDQALKVLKAVEKTFGHKFHYTEALVGAVAIDATGNPFPEETLKVCQSSDAILFGAIGHPKYDNDPKAKVRPEQGLLAMRKALGLFANIRPVNTYKILENASPLRADLVQNVDFVVFRELTGGIYFGTRGRSEDGNMAFDTCTYTRDEILRISKLAFESARQRKNHVTLVDKANVLASSRLWREVVKEYHAANFADVTLDFMFVDNAAMKIIQQPAFFDVVLTENMFGDIITDEASVITGSMGMLPSASVGSVVGLYEPIHGSYPEGAGLNIANPNGAILSAALLLETSFGMVAEAKAIRAAVEKAMEDGILTIDIRREKPNSTTEVGDYVANLVAKGASVVA

SEQ ID NO: 19694 - protein, 88 aa, Glycine max
ANQGQLFEALNISALWDLPSILVCENNHYGMGTAEWRAAKSPAYYKRGDYVPGLTGDGLDAVAVKHTCEFAGGIALKSARIFVEIDSY

SEQ ID NO: 19695 - protein, 198 aa, Streptococcus pneumoniae
GIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQASGAGNEIQLTDAIDTLNKTQR

SEQ ID NO: 19696 - protein, 470 aa, Methylobacterium extorquens
NSLTAGSRGPVLMQDYHLIEKMAHFNRERIPERVVHAKGYGAYGTFRLTRSLSEFTRAKVLTEVGKDVPMVARFSTVGGESGSADTARDPRGFALKFYTEEGNWDLVGNNTPIFFVRDAIKFSDFIRTQKRDPRTHLKPHWRRWDFWSLSPEAIHQVMFLYSDRGTPKSARFMNGYGSHTFSLWNDRGERHWVKFHFHTKQGIQNFSADEADEVAGKDPDYSSADLSTAIEQGDFPKWKVSVQLMPELDADTYRINPFDLTKVWPHGDYPLIEIGEMELNRNPENYFAEIEQSAFEPSNVVPGIGFSPHKMLQNRVLSYADAHRYRLGVNYQQIPVNQAKNADVQTYHRDGAMRTDGNHGAQVDYEPNSFGGPKQDPSFSEPPLRIQGDAGRYGWPGDDEDLYGQPKLFWTKVLDEGGRKRLVENIVTSMGDSPRHIQERMIAHWFKVHEDFGRGVAQGLGIDTAQAAAE

SEQ ID NO: 19697 - protein, 138 aa, Eremothecium gossypii
MSKVPRSFRLLEELEKGEKGMGPESCSYGLADGDDISMTHWNGTILGPPHSSHENRIYSVVIECGAEYPDRPPKVRFISRINLPCVDPSTGEVRPEAFHALRDWKRSSNMETLLQDLRKEMASSANKKLPQPPEGSTF

SEQ ID NO: 19698 - protein, 368 aa, Prunus armeniaca
MATLVEPPDGIRQRGKHYYSMWQTLFEVDTKYVPIKPIGRGAYGIVCSSINRATNEKVAIKKINNVFENRIDALRTLRELKLLRHIRHENVIALKDVMMPIHRTSFKDVYFVYELMDTDLHQIIKSSQPLSSDHCKYFLFQLLRGLKYLHSANILHRDLKPGNLLINANCDLKICDFGLARTSGGTGQFMTEYVVTRWYRAPELLLCCDNYGTSIDVWSVGCIFAEILGRKPIFPGTECLNQLKLIINVLGSQHEPDLAFIDNPKARKYIKSLPYSRGTHFSRLYPQADPLAIDLLQRMLVFDPTKRISVTEALQHPYMSGLYDPRCNPPAQVPINLDIDENLAEPMIREMMWHEMLHYHPEAAFVNA

SEQ ID NO: 19699 - protein, 488 aa, Porphyra purpurea
MSQSVESRTRIKSERYESGVIPYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASAAAGEIKGHYLNVTAATMEDMYERAEFSKVVGSIICMIDLVIGYTAIQSMAIWARKNDMILHLHRAGNSTYSRQKNHGMNFRVICKWMRMAGVDHIHAGTVVGKLEGDPLMIKGFYNTLLAGETEINLPQGLFFAQNWASLRKVVPVASGGIHAGQMHQLLDYLGDDVVLQFGGGTIGHPDGIQAGATANRVALESMVMARNEGRDFVAEGPQILRDAAKTCGPLQTALDLWKDISFNYTSTDTADFVETPTANV

SEQ ID NO: 19700 - protein, 537 aa, GIBBERELLA ZEAE PH-1
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICACVGFIILGIVINCGGVGDQGYIGVKYWQDPGAFTSFKGFCAVFVVAAFSFGGTEMVGLAAAESADPRRSIPMASKQVFWRIAIFYILNLFIVGLILPANDPRLMGASGANTKASPFVLAIQDAGIKVLPSIMNAVITVAVLSVANSCTFGSTRTIQAMAERNMAPGFFKYIDSKGRPLYCVLLQIAFGLLAYIGAAPQGMEIFGWLLALTGLGFLFVWGSICLAHIRMRAGMKAQGVNLGLIPYKTPFGVAGSYLGLGLNILALIASFYTALYPASGASPAAEAFFSSYLAFFSVTLLYVGYKVCTRKWQMYVRPSEMDLSTGAVFLEEEEPKEPFVWADAPKRVLRSFF

SEQ ID NO: 19701 - protein, 627 aa, ASPERGILLUS NIDULANS FGSC A4
MHIKEKLAQNEAAGKIGISFEFFPPKTAQGVQNLYDRMDRMHGLGPSFIDITWGAGGRLSDLTCEMVNVAQSVYGLETCMHLTCTDMPQERVDAALQAAYKAGCTNILALRGDPPREKEVWEAADGGFRYAKDLVKYIREKYGNHFCIGVGGYPEGADDNSDVDQLIDHLKEKVDAGSSFIVTQMFYDTDNFIKWVEKCRAKGINVPIIPGIMPIQTYAAFIRRANWTKTHIPPDWLEALEPVKNDDAAVKQVGKRLIADMCRRLIASGIKHLHFYTMNLAQSTQLVLEELELTPTAEAPIPRPLPWRPSLGLNRREEDVRPIFWRNRNSSYIARTAIWDEFPNGRWTDSRSPAFGELELYGVGLKGTNEQNIKLWGEPNSLRDLAEVFVRFLEGNLDRLPWSDSPITPETSAIKDALVELNRRGFFTINSQPAVNGVKSSHPVFGWGPKNGFVYQKAYLELLVPPYVIDELIARIEANEDLTYHAVTKKGELRTNTRDSPNALTWGIFAGREVVQPTIVETVSFLAWKDEAYQLGEDWAKCHEASSPTRKLLQGIMDSWYLVNIVNNDFHNTYDLFELFKDLNVKDLELEISGGITEDKAHHNGTANGATNGTTSNGTAAEQPVKN

SEQ ID NO: 19702 - protein, 331 aa, Glycine max
  unsure (1)..(331): unsure at all Xaa locations
MAHPTSSGQSHDLKKEDCKETRSLVVCFGEMLIDFVPTVGGVSLAEAPAFKKAPGGAPANVAVGISRLGGSSAFVGKVGADEFGYMLGDILKQNNVETSGMRFDPNARTALAFVTLRDXGEREFLFFRNPSADMLLQESELDENLIXSLIDEPCKSAHLAAMRFAKESGCILSYDPNLRLALWPSAEAARDGIMSIWDQADIIKISEEEITFLTGGDDPYDDNVVLNKLFHPNLKLLIVTEGSEGCRYYTKEFKGRVAGVEVKPVDTTGAGDAFVSGIIYSLASDQSLFQNEEHLRKALHFANVCGAITVTERGAILALPTKEAVLQFAAT

SEQ ID NO: 19703 - protein, 216 aa, Zea mays
ACLQDLFQHLYVFHIFQFTLHFRDHSNFVNCIRYAPDGSKFITVSSDKKGLIYDGKTGEKIGELSTEGGHTRSIYAVSWNPDSKQVLTVSADKSAKVWDIFEDASGKLNRTLVCPGIGGVDDMLVGCLWQNDHLVTVSLGGTFNVFSASNPDQEPVTFAGHLKTVSSLVFFPQSSPRTILSTSYDGVIMRWILGVGFGGRLMRKNNTQIKCFAAGM

SEQ ID NO: 19704 - protein, 333 aa, Rhodobacter sphaeroides
MTIRVAINGFGRIGRNVLRAIVESGRTDIEVVAINDLGQVETNAHLLRFDSVHGRFPAKVTSGDDWIDVGRGPIKVTAIRNPAELPWAGVDMAMECTGIFTTKEKAAAHLQNGAKRVLVSAPCDGADRTIVYGVNHATLTADDLVVSNASCTTNCLSPVAKVLHDAIGIAKGFMTTIHSYTGDQPTLDTMHKDLYRARAAALSMIPTSTGAAKAVGLVLPELKGRLDGVSIRVPTPNVSVVDLVFEAARDTTVEEVNAAIEAAACGPLKGVLGFTTEPNVSSDFNHDPHSSVFHMDQTKVMEGRMVRILSWYDNEWGFSNRMADTAVAMGRLL

SEQ ID NO: 19705 - protein, 554 aa, Selenomonas ruminantium
MNGAQAVVACLREQGVDTVFGYPGGMILPLYDALYDSKEIKQVLVTHEQNAAHAADGYARASGKVGVCIATSGPGATNLVTGLATAFMDSIPVVAITGQVDTTLLGRDAFQETDILDVTMPITKHNYKIKDARHLLSTIREAFTLAKKGRPGPVLVDVPRDLFFQEVAWEEVPACTKKVGKPDADFLICAAEAAREIVKAQRPVVIVGGGVVSAGATAEVTAFVEKYNLPVAHTLMGLGAIPREHPQSLGFAGMHGEKAANHAIAAADLIIAIGSRFGDRQTGNVKKYTQDTKFIHIDIDPAEIDKNIGNSLGLAGDMKVILGLLMKQEAVGNIDEWWQQIQSWKETYDYDYHVNRLTVPWALHQVAQNTKGKPYAFATDVGQHQMWAALHLRIEEPRTWLTSGGLGTMGFGLAAAMGAQMYYGDSRRVIHVAGDGGIKMTGNEFYTIARLNLPVISLIVNNTSLGMIRQLQKVMYKERYIACEFDYQMDYAAYAGSFGIKAETVSTQEEFAEALNRALADQDHPRVIVLNVWRSFVEPMIKGGARIDEFVEFK

SEQ ID NO: 19706 - protein, 355 aa, Emericella nidulans
MTTNSTGNGGAVGQENINTDIVTLSRFFTEEQTKVPEATGDFTLLCHALQFSFKSIAYYIRRASLINLTGLAGSSNTTGDDQKKLDVIGNDLFVSAMRTSGKCRILVSEEEEEAIIFDEHPNARYAVVCDPIDGSSNLDAGVSVGTIFGIFRLPDDILGPGKKVTAKDVLLPGTEMVAAGFTMYGASAQLVITMKNGGVNGFTLENSLGEFILTHPNMKLPPSRAIYSVNEGNSMYWDDWCNAYFDSLKRPGEGKKPYSARYIGSMVADAYRTLLYGGVFAYPADSKSPKGKLRILYECAPMAMVFENAGGKAVNSRMERLLSVQPESIHDKSGVFLGSRDEVQKVIDTYNKYKK

SEQ ID NO: 19707 - protein, 519 aa, Candida apicola
MNINFSDALMLGGISLSFLLASQAIYFYFIYSPRAKKLGCAPPPIFFSFPLGIPDLIRLVNAWFHDDLLEWFTHRFEEFGRRTAFQSVAGQLWIGTIEPENIKTMLATSFKDYSLGFRYNAMYGLLGNGIFTLSGDGWKNSRALLRPQFSREQVSHLESMRTHINMMINNHFKGGQVVDAQVLYHNLTIDTATEFLFGESTNTLDPALAQQGLPGPKGLVTGEQFAEAFTSALELLSVRVMAGAAWFLVWTPKFWRSCKVCHNFIDYFVYKALATPMEKGQDADRYVFIRELTKETSDPRVIRDQALNILLAGRDTTAALLSFTTYYLGAYPEVYDELREAVIADFGSADAEPPTFEQLKQCKVLQNVIREVLRLHPNVPLNFREAIADTTFPTGGGPNGDQPIFVPKGQKVFYATYVMQRNAGIWGPDSTSFRPDRWNEPREALASGWDYIPFNGGPRICLGQQFALTEASYTLVRICQEFSRIEVLHPDVITARNVMKQRMRLPNSSSGGVITRFIR

SEQ ID NO: 19708 - protein, 690 aa, Pyrococcus furiosus DSM 3638
MVDRFYDRNPTNNEPFYDPEKKNYRLYWGGDIEGIIERLDYIESLGVSMIWLSPLNDNINRMAGGSAPYHGYWPRDFKRIDEHFGTWEDFRRLVEEAKKRGICIIVDYVPNHSNPATDGEFGALYDNGTLVTNYYEDRKNATRNPYTASLENIYHHNGNINDWFGFQLKYANLFGLADFNQMNDFVDNYLKEGAALFVKNGACGFRIDAVKHIELGWLETFYLYLYQISDEPLFIYGEYFANTPDKTFDLYEFYRYSNVSSLLNIPIRESIARTFAYGGSFEQLAKMLEEYYSLFVYPNKQLNFLDSHDLVRFLNMNPNKDRYHMALGLVMTLPGIPVIYYGDESYLVSKEGKGDPYNRPMMVFDNSTKAAEIIRKLSLLRKVNDALAYSDFRTVYVDYNTWIFERKFGSHKILVALNKGPDKNITISLNWTDGTYIDIIEGAILKVKEGQGEIKLPRYSFYVFHVEEEQKTPLIGSITPYIAQPGQKILIAGAGLNGNIKVYIGGRRARIIEKEENSILVEVPEIKTMNAWIPVWVVVNGTRSNEVKLRYYSSNDIPALIVLQGNYTGYLWVKGNIPELSEPRPLLKSPTGHYFAVVPLPRNKTFTVQLYKGLPWEPLQPTNVTLYGIGNKTVILNEAAPETPVCGPGIVAVFALLPLLKRKKKKSPNTTITPYGVPIVAVSWIVRWCL

SEQ ID NO: 19709 - protein, 238 aa, Schizosaccharomyces pombe
MSGLPESKLGTKQYWDNVYEREVSNFTEFNDEGEVWFGEEAEERIVQWLEDHISTSFREVSEAAPFRVLDLGTGNGHLLFRLLEEEDTLLPSPCQLVGVDYSEAAIVLAKNIARHRQFSDKVKFQQLDIIKDSKFCSKDWDLILDKGTFDAISLSGELLDGRPLNSVYVDRVRGMLSPNGIFLITSCNWTIQELEERFTKNGFIVHSTVPVPVFEFQGSTGSSTSVIAFQIDPSFNRK

SEQ ID NO: 19710 - protein, 463 aa, Capreolia implexa
MGYWDPDYVVKETDVLALFRVTPQPGVDPVEASAAVAGESSTATWTVVWTDLLTACDLYRAKAYKVDAVPNASDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKELGTVIVMIDLVIGYTAIQTMAIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDYVAEGPQILRDAAKTCGPLQTALDLWKDITFNYTSTDTADFVETPTANV

SEQ ID NO: 19711 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHXGIGIXXXXXXXXXXXVRAAIEYAIATDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 19712 - protein, 812 aa, Pseudomonas aeruginosa PAO1
MPDSQDQTPSAVQTLKASILAKLRYSVGRDPSTACPHDWFEAVALAVRDHIIDHWEEATPQGEAPARKRVYYLSLEFLIGRLLLDNLGNLGLLEETRQALAELGVDLQRIVALEPDAALGNGGLGRLAACFMESMASLDIPAHGYGIRYEHGLFRQVLTDGWQQEQTETWLDFGNPWEFERPEVSYYIDFGGSVQVDSEHSGRAIWRPDERIRAIAYDTPIVGWRRASVNTLRLWRARAEEDLQLDRFNAGDHIGAVVDVVKAESISRVLYPADSTEAGQELRLRQEYFFVSASLQDLLDRHLRHHHDLRSLPEQVAIQLNDTHPAIAVAELMRQLVDVHQLAWPDAWALSVATLSYTNHTLLPEALESWPVALMERLLPRHMQIIYLINAFHIDALRAQDIHDFDLLRSVSLIEEGHGRRVRMGNLAFLGSHQINGVSALHTELMRETVFHDLHRLYPQRISNKTNGVSFRRWLFQANPGLTELLVETLGADLLDTPERRLPDLEEHVEDARLRARFAEQRRQNKTALARLVLDSLGVAIEPEALFDVHIKRIHEYKRQLLNLLHTVALYQEIRNDPTADRVPRVKIFAGKAAASYHQAKLIIKLANDIARTINDDPTVRGLLKLVFLPNYNVSLAEAIIPAADLSEQISTAGLEASGTSNMKFALNGALTIGTLDGANVEMSQRIGLEHMFIFGLSAQQVEQRRQAGELEMGGVIAASPRLEEALEAIRSGLFSADDRSRYEGLVDGLVHDDRFMLCADFEAYWHAQCRVEEVWREPDRWWRSALLNVARIGWFSADRTISEYARDIWKL

SEQ ID NO: 19713 - protein, 303 aa, Physcomitrella patens
MDQYEKVEKIGEGTYGVVYKARDRLTNETIALKKIRLEQEDEGVPSTAIREISLLKEMHHGNIVRLQDVVHSEKRLYLVFEYLDLDLKKHMDTCPDLAKDPRLIKTFLYQILRGIAYCHAHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRTLGTPNEEVWPGVTSLPDFKTAFPKWPPKPLSSVVPSLEPAGIDLLEVCDLSTPASEFCVVLFFFIISTFSLIVRLKQCMQSYAS

SEQ ID NO: 19714 - protein, 117 aa, Triticum aestivum
  unsure (1)..(117): unsure at all Xaa locations
MAPTVMASSATSVAPFQGLKSTAGLPVSRRSNGASLGSVSNGGRIRCMQVWPIEGIKXFETLSYLPPLNTEASSSSRLLXVQWVPCLXFNKVGFIFRXEHNASPGXYNGXXWXXWXC

SEQ ID NO: 19715 - protein, 439 aa, Neurospora crassa
MGQTLSEPVVEKASATGGDERLIYGVSAMQGWRISMEDAHTTVLDLLANNPKEAKDHSQKLSFFGVFDGHGGDKVALFAGANIHDIIAKQDTFKTGNYEQALKDGFLATDRAILNDPKYEEEVSGCTACVGLITDEKIFVANAGDSRSVLGVKGRAKPLSFDHKPQNEGEKARITAAGGFVDFGRVNGNLALSRAIGDFEFKKSAELAPEQQIVTAYPDVMVHDLADDDEFLVLACDGIWDCQSSQAVVEFVRRGIAAKQDLDKICENMMDNCLASNSETGGVGCDNMTMIIVGFLRGRTKEEWYEEIAKRVANGDGPCAPPEYAEFRGPGVHHNFDDSDSGYDLEDNGNKGKPFGMGGYKGRIIFLGDGTEVLTDADDTEMFDNVDEDKDLASQVSKSPSSITTNDQDQKEQAAVAAAAADNSTQNAKKEETSSPAKA

SEQ ID NO: 19716 - protein, 742 aa, Halobacterium salinarum
MNEVQLEVAKAYPNDSGRGIARLDPDTLLHLKLSPGDIIDIEGAETTAAKVWRADRQDWNTDTIRIDGFTRQNAEVGIGERVKIRKADAEKADTLVLAPPEEASVQFGSDAAGMVKRQILKRPVVARDIVPVMSSTNHPFMRSPGQAIPLIAVETEPEGVCLVTEDTDVELREEPISGFERTGGGITYEDIGGLENEIQRVREMVELPMKHPQIFQKLGIEPPQGVLLHGPPGTGKTLLAKAVANETSASFFSIAGPEIISKYYGESEQQLREIFEDAKDDSPSIIFIDELDSIAPKREDVTGEVERRVVAQLLTMMDGLEGRGQVIVIAATNRVDAVDPALRRPGRFDREIEIGVPDEIGREEILKIHTRGMPLSDDVNLSTLADDTHGFVGADIESLSKEAAMRALRRYLPEIDLDEEDIPPSLIDRMIVKREDFKGALSEVEPSAMREVLVELPKITWDDVGGLTEAKNNVKESVEWPLNQPEKFTRMGVEPPAGVLLYGPPGTGKTLMAKAVANETNANFISVRGPQLLSKWVGESEKAIRQTFRKARQVAPTVIFFDELDSLAPGRGQTGGNNVSERVVNQLLTELDGLEEMEEVMVIAATNRPDIIDPALIRSGRFDRLVQVGQPGIEGREQILKIHTQDTPLAADVSLRELAERADGYVGSDLANIAREAAIEALRDDEDADDVGMAHFRAAMENVRPTITDDLMEYYDQVEDQFKGSQGPNVNSRQGSEHIGFQ

SEQ ID NO: 19717 - protein, 340 aa, Oryza sativa; identical to SEQ ID NO: 6603

SEQ ID NO: 19718 - protein, 306 aa, Zea mays
  unsure (1)..(306): unsure at all Xaa locations
MSYSYPATTPRQHKPLSAPSQPSSDLNPGGRSLPPSSPRDSERRRPPSMEHDAEARRGFARMGFGCKHYRRRCRIRAPCCGDVFHCRHCHNESTKDGHELDRHDVQSVICLVCDTEQPIAQVCCNCGVCMGEYFCAACNFLDDDVDKEQFHCDDCGICRVGGKEYFFHCQKCGSCYSTTLRDRHCCIENSMKNNCPICYEAXYLFDSLRETSVLRCGHTMHLQCFHEMLKHDKFSCPICATPIFDMDKFFKALDAEMEASYLYTGKGWVVCNDCRDTTQVFSGVAGHKCCHCQSHNTCRVAPPVLP

SEQ ID NO: 19719 - protein, 333 aa, Zea mays
  unsure (1)..(333): unsure at all Xaa locations
HRLGVWTVNVNPTHASSPPVQVPHRPLVAFPSRRAMDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQDEVVTRIEERISAWTFLPPENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPVIEGQKWSATKWIHVRSFDLTRQAXGPSDGCEDDNVLCPQWAAVGECAKNPNYMVGTKEAPGFCRKSCKVCAE

SEQ ID NO: 19720 - protein, 352 aa, Hordeum vulgare
MAASDEMPMVQDLVSAGVQEPPSRYLVHEQDRHGDLLAAHEMPEPIPLIDLSRLMDADEADKLRAALQTWGFFLATNHGIEDSLMEAMMSASREFFRQPSEEKQKCSNLVDGNGKHYQVEGYGSDKVESEDQVLNWNDRLHLRVEPEDERNFAKWPSHPESFRDVLNEYASKTKKIRDLVLRSIAKLLEIDEDYFVNQISNKASGFARLYYYPPCPRPDLVLGLTPHSDGNLLTILFVDDDVGGLQVQRDGKWYNVPAKPHTLVINLADCLEIMNNGIFRSPVHRVVTNTEKERLSLAVFYAVDEETVLEPAPGLLDEKRPPRYRKMMAKDFVVGLFEHFLQGKRFIDTLKM

SEQ ID NO: 19721 - protein, 447 aa, Desulfovibrio vulgaris subsp. vulgaris (strain Hildenborough)
MDIPVFNCKNGDDVIRAVKEYNVSFVQFWFVDILGNLKSFQVTPSELEAAFEEGMGFDGSSILGFTRIEESDMVAFPDATTFQICSWRPLERPVARMFCDIRTPDGTPYEGDPRYILRKLIDKAAQKGYTFYVGPELEFFFFSSPQCPTPIDAGGYFDAPPLDLGNDVRRDIIFALQRMGIPVEYSHHEVAPSQHEIDLRYNEAMKMADVVMTYKVVVKEMARKHGIYATFMPKPIFGENGSGMHVHQSLFRNGKNAFFDPNDQHNLSHECRSYIAGLLKHAREFCCVTNQWINSYKRLVPGYEAPVYIAWAQRNRSALIRVPMYKPGKEAATRIELRSPDPACNPYLAFAVMLGAGLEGIENNYELPKAVEANIFHMGEEDLGKHGIGSLPGSLYEAAMELRNSNLMKEILGEHTHANIVGNKLIEWDDYRTHISEFELKRYLPIL

SEQ ID NO: 19722 - protein, 350 aa, Schizosaccharomyces pombe
MRKGAGDKYLLILALVFLYTKENSIYFTLHRVNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 19723 - protein, 296 aa, Bacillus cereus ATCC 14579
MMKKVRKAIIPAAGLGTRFLPATKAMPKEMLPIVDKPTIQYIVEEAVKSGIEDIIIVTGKTKRSIEDHFDNAFELEQNLLEKKKYELLEKVQASSKMVDIHYIRQKEPKGLGHAVWCARKFIGDEPFAVLLGDDIVQAEKPCLRQLMDEYEKTLSSVIGVQTVPESETHRYGIIDPLEQEGRRYQVRNFVEKPAQGTAPSNLAIMGRYILTPEIFMFLEQQHVGAGGEIQLTDAIQSLNEIQRVFAYDFEGKRYDVGEKLGFVQTTIEMALQHPELRDDMVAMMKKILEEQANQES

SEQ ID NO: 19724 - protein, 354 aa, Enterococcus faecium
MKKFAITALGRACIDLNSVEINQPMEETKTFKKYVGGSPANIAIGLAKLGETVGFIGKLSNDQHGRFIKDFMSKAGVDSSQMIFDQEGHKSGLAFTEIKSPSECSILMYREDVADLYLTPDEVSEEYIEASEMLLISGTALAQSPSREAALLAVEYAHKHDVKVIFELDYRPYTWGSTAETAVYYTLLAQKAHIVIGTRDEFDVLENSVGGNNQQTVERLFQYTPELILIKHGVDGSFAYEKDGTITRGYAYKAQVLKTFGAGDSYAAAFLFALMQGKMIENALQYASASSALVVSRHSSSEAMPSVSEIEAVIAEQAGGRKFMPKTLRLTTAQALVKYLNQQFLIVDDQSYPL

SEQ ID NO: 19725 - protein, 336 aa, Glycine max
GPQDKIHSKMGEGTFGQVLECWDRERKEMVAIKIVRGIKKYREAAMIEIEVLQQLGKHDKGSNRCVQIRNWFDYRNHICIVFEKLGPSLYDFLRKNSYRSFPIDLVREIGWQLLECVAFMHDLRMIHTDLKPENILLVSPEYLKIPDYKSTTRSPSSFFKRVPKSSAIKVIDFGSTTYEREDQTYIVSTRHYRAPEVILGLGWSYPCDIWSVGCILVELCTGEALFQTHENLEHLAMMERVLGPIPQQMLKRVDRHAEKYVRRGRLDWPEGAISRESIKAVMKLPRLQNLIMQHVDHSAGDLIHLLQGLLRYDPFERLTARDALRHSFFMRDHLRR

SEQ ID NO: 19726 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 19727 - protein, 98 aa, Buchnera aphidicola
  unsure (1)..(98): unsure at all Xaa locations
LPSASLNDSXXGLYEPAGGSAPDIAGKNIANPIAQILSIAMLVRYTMKLPIISDQIESAVIDTLKKGYRTLDIANDKEKCESTNDIGDIISYILKKRI

SEQ ID NO: 19728 - protein, 433 aa, Picea mariana
MEHLNTAAAQASSSLYGVGMAEYGDAGVSSMMALITQHEPHDSESIMSTRMPSSFSSFHGHADCLLSAAMFQASQGDHKLKRQPGMDQLVSEQAVMSDSSMPSVKTEVCSGLRNQFEFHREQTGNCYTDQSPNTPVNPLVTSLASQARGEAQMIPSLDANSPHFNVDNEEYAIKSKILAHPQYPSLLGAYIDCQKIGAPPEAVARLDALTHEYQNQQRRTVSIGMDPELDQFMEAYCEILTKYHEELAKPFKEAMTFLMKIEAQFNSLGKGTIRISPPAENDEKTEGGGSSEEVEDGSGGETDFQEVDHHAVEDRELKDHLLRRYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHLMTEGYHLDC

SEQ ID NO: 19729 - protein, 368 aa, Ipomoea batatas
MATTLSTLTALAGETALQSSFVRDEDERPKVGYNEFSDEIPVISLKGIDDVNGRRVQIRNDIVKACEDWGIFQVVDHGVDAGLIGEMTRLSKDFFALPPEEKLRFDMSGGKKGGFIVSSHLQGEAVKDWREIVTYFSYPVRARDYSRWPDKPEGWRAVTEKYSEKFMDLACKLLEVLSEAMGLEKEALTKACVDMDQKVVVNFYPKCPQPDLTLGLKRHTDPGTITLLLQDQVGGLQATKDGGKTWITVQPIDGAFVVNLGDHGHFLSNGRFKNADHQAVVNSERSRVSIATFQNPAPEAKVYPLKVREGEKPILEEPITFAEMYRRKMSKDLELARLKKFAKEQQQIINAATADKNLETKPIDQILA

SEQ ID NO: 19730 - protein, 272 aa, Oryza rufipogon
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRPPGRTDNEIKNYWNSTLSRKIGTAATAAAGSRGGSTPDTARATDAASSSSVVPPGQQQQPASRADTDTATAAAAAAATTTTVWAPKAVRCTRGFFFHDRETAPLAAAAPAPAGELGDGDDVDCDYYCSGSSSAATTTSSSSLPAVVEPCFSAGDDWMDDVRALASFLDTDDAWNLCA

SEQ ID NO: 19731 - protein, 930 aa, Neurospora crassa
MNWILEAGDGDPGGCKGEDYVRPGNKDTWYQFIISVSLGISAFLAFCALRPRWKSLYASRKRASMADPSIALPQLPDTFFGWMGTLYRVTERQVLASAGLDAYVFLNFFKMAMKLFVIIFFFALAVLEPINRAFPDDLNTSEVPPTQVFRQYTYPYGHTTLYDDDPDQPDDSFKKSKRYLWSYLVFTYFFTGLTLFLMNRETFKVLRVRQDYLGTQSTITDRTFRLSGIPKDLRTEKDIKNLVEKLEIGKVENVTLCRKWKELDDLMDKRQAILAKLEETWIAYLGQKPVQLARGPPPNTTADGDLENGRLIPDLGNEEVGETGRLLGNTTSDLISSERPRPQTRIWYGFLRLQSRKTDAIDYYTEKLRVLDDQIRAARKKHYEPTDLAFVTMDSIAACQMAIQALIDPHPGQLLTKPAPAPSDIEWRNTYASRLTRRVRSVAVTLFVAFLTVVWLVPVAFLASFLSICTIEAYFKGFAMWLKQYDLARALVQTGLPTAVVSLLNVAVPYFYDYLSYQQGMLSRGDAALSTISKNFFFTFFNIFLIFTVFGAVTSIIDVLRESLKDTTYIAYVLASKIENLGVFYTNFIMLQGIGLFPFRLLQFGSVSLYPINRLGAKTPRDFAQIVSPPMFYYGFYLPTALLVFILCLVYSALPQGYKVVGLGVAYFTLGYFTYKYQLLYAMEQPAHATGGAWNMICYRIMLGLLVFQLTMSGYLALRKAFTAALLVSPLLIITVWYGYSFRRHFEPLTKFIALRSIKRGEDIGENAILDEDLDGEGAETRERIRRGSTLDEDKEKGAKFVNPNLVKPLEQPWIFKDAPPLLYPSSSLSDVEDRYTDEEPNSGGGSDLYAGSRRPTRNANGLRVETSRGSSQSRADSGGGYADLLGADMYTGLGRGGERTPRTPAADTPRSNASSAASLGDTHIWRDGF

SEQ ID NO: 19732 - protein, 489 aa, Burkholderia fungorum
MAVFAIQRLYIGGAYVDATSGETFDTLDPATGETLASVQQASAADVERAVQSAREGQREWAALTAMQRSRVLRRAVEILRERNDELAALETRDTGKPIAETLAVDIATGADVIEYYAGLATAIEGQQIPLRPTSFVYTRREPLGVCAGIGAWNYPIQIACWKSAPALAAGNAMIFKPSEITPLSALKLAEIYTEAGVPAGVFNVVQGDGRVGAMLAAHPDIEKISFTGGVETGKKVMSLAGASSLKEVTMELGGKSPLLVFDDADLERAADIAMSANFFSSGQVCTNGTRVFVQRGVLERFEALVLERVKRIRVGAPTNAATNFGPLASAAQLQKVLGYIESGKQEGARLMAGGKRLTEGHFGNGQYVEPTVFTGCHDDMRIVREEIFGPVMSILVFDDEDEAIARANRTAYGLAAGVVTGNLARAHRVIHRLEAGICWINTWGESPAEMPVGGYKQSGVGRENGLTTLEHYTRIKSVQVELGPYQPVF

SEQ ID NO: 19733 - protein, 251 aa, Vibrio sp. ANT-300
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIGYEPVWAIGTGKTATPEIAQEIPAHIRSWLAEQDAAVANKVQILYGGSVKPANSAELFGQADIDGGLVGGASLDAVEFSKVISGASA

SEQ ID NO: 19734 - protein, 477 aa, Ceramium inkyuii
KNERYESGVIPYAKMGYWDPEYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLDSYLKVDLPKGIFFEQDWASLRKVTPVASGGIHCGQMHQLLDYLGNDVVLQFGGGTIGHPDGIQAGATANRVALEAMVIARNEGRDYVTEGPQILRDAAKTCGPLQTALDLWKDITFNYTSTDTADFVETPTANV

SEQ ID NO: 19735 - protein, 426 aa, Lycopersicon esculentum
MEFQDHFSQEMVLHQQQQQQQQQQNAVLRSMLPESPHHDARKSPPTWLNTSLLRQQHSQFGNASSPSSAAAAAAVAGGNNFLHLQTSNSDSSNSNQWLSPTAAAGGGSNGGGSGHNDELSESMNFAKKMSQQHSGGGEENNNNNNNNNNNNNEEENSWEREKCKADILNHPLYDQLLSAHVSCLRIATPVDQLPRIDAQLAQSQNVVAKYSVLGQGQPPLDDKDLDQFMTHYVLLLSSFKEQLQQHVRVHAMEAVMACWELEQSLQSLTGVAPGEGTGATMSDDDDDQADSDTNFLDGGFDGPDSMGFGPLVPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSSSQKSQTQECR

SEQ ID NO: 19736 - protein, 164 aa, Glycine max
  unsure (1)..(164): unsure at all Xaa locations
FSRPARRYDTRATIFSPEGRLYQVEYAMEAIGQAGTCLGIRAPDGIFIAAQKLTANKLLDDRIMSEKIYKVSANIFCTAAGITSDANVLVDKLREMAVMNTLDFGENIPVEQLVIRLCNTKQHYTQVGGKRPYGVSLLYAGWDTHHGFEIYQSDPXGNYXGWKA

SEQ ID NO: 19737 - protein, 491 aa, Rhizobium sp. NGR234
MTLTSALTRHLKCPELFRNLANEPHPSVAGQRQRFSVFNPSTGELLAEVPDMGAADAHAAIERADAAQEPWSGLTARARSDILWKWHRFILEHSDDLAAILTAEMGKPLGEAKSEVQHAAAYLQWYAEEANRIYGETISAPSTDRRMLVIKQPIGVVGAITPWNFPASMVARKISPALAAGCTVVLKPAEQTPLVAGAMFALAKLAGFPDGVLNLVYASEGDAIGRELCTNPKVRKISFTGSTEVGRLLMRQCSDQIKRISFELGGNAPFIVFDDADIDAAVDGAIQAKFRNAGQTCVSANRIYVQSGVYAEFAEKFTERVRTLKVGDGFDPNVAIGPLINQEALKKIELHISDAVQKGARVRSGGRRTGSSGTFFEPTVVTDVSKTMRLAEEETFGPLAPLLRFDDADHVVREANDTIYGLAAYFYASNLKRVWRVAEALEYGMVGINTGRMSSEAAPFGGVKQSGIGREGSRHGLEDYLDMKYLCVGGL

SEQ ID NO: 19738 - protein, 501 aa, Asparagus officinalis
MTVSITAAVQLFLLLLLLLPLLFVHHKTKPKTKCRSPPGPPPLPVIGNLHQLSLLLHQSLYRLSKIHGPIFKLSLGRVPVLVISSPSLAKQVLKTHDLACCSRASTVSFKEYTYDGCDVAGAPYGDSWRNLRKIFVLKLLSSKKLTSFRLVQEEEIEGMISSIRTRSDTNATVNITEFVVRLANNITFRVAFGYRSEGEYGEKSRFQRLLESGNDTVASFYVGDYFPGLGWLDKMTGKLGKMKRNARDLDEFYQEVIDAHMKDGRKEDGKEDIVDVLLRLREEGQLTMDHIKGALMNIFVGGTDTSAASIAWAMAELARKPKVMKKAQEEVRKAASKKGKVEENDLAQLQYIKCVVNETLRLHLPLPLLVPRETIQHCEINGYDVSAKTRVLVNAWAIGRDEDAWENPEEFNPDRFVGSSLDYKGQDFQFIPFGAGRRICPGIQFGVETVELALANLLYAFNWELPPGVERENIDMHEAPGLVTRRATDLRLVATNYEEAN

SEQ ID NO: 19739 - protein, 410 aa, Blumeria graminis
MSDMQGRKVFKVFNQDFVVDERYNVTKELGQGAYGIVCAATNISTQEGVAIKKVTNVFSKKILAKRALREIKLLQHFRGHRNITCLYDMDIPRPENFNETYLYEELMECDLAAIIRSGQPLTDAHFQSFIYQILCGLKYVHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHVLGTPNEETLARIGSPRAQEYVRNLPFMAKRPFAQIFPNANPDALDLLNRMLAFDPASRISVEEALEHPFLQIWHDVSDEPCCPTTFNFDFEVTDDVGEMRKMILDEVARFRHHVRVQPGMQSPSNDPSVPTLQTSVAWGSEDPRPQENNDQEITGLERDLTVGLDR

SEQ ID NO: 19740 - protein, 212 aa, Paenibacillus polymyxa
ANVFWEPLSYYNPSTWQKADGYSNGDMFNCTWRANNVNFTNDGKMKLSLTSSAYNKFDGGEYRSKNTYRYGLYEVNMKPAKNTGIVSSFFTYTGPANGTQWDEIDIEFLGKDTTKVQFNYYTNGIGGHEKVVDLGFDASSGFHTYAFDWQPGYIKWYVDGVLKHTATTNIPKTPGQIMMNLWNGTGVDSWLGPYNGVNPLYAEYDWVKYTSN

SEQ ID NO: 19741 - protein, 485 aa, Oceanobacillus iheyensis HTE831
MTKGNNDEQNNSRNYSQGFGSQGLHGYPGNASDKSHANPAAFNWNIDLPAEIHSQTVGKRGPILKQDNIEHETLQTFIHEKITERPVHVKGWGAFGYFETLYSMSDYTTLSFLQIPGTQVPVFVRFSLAVSTKGTPDTSRNVRGFATKFYSEDGIFDLICNHIPVFSVRDTIRFPEAIKAFLPSPVNNLIDPTRYWNFVARAPESLLFTLLVYSNLGTVKSLRHLPGHSVNTYVWKNAEGKRYFIKYTWAPIAGEEYIRNEEAVKLAGENPDIAGQDLHDAIERGEPVEYGLYIQIMDPKDAASLPYDPLDDTKLWDQQQFPFKPVGVMKLNKNPDNYMEQVEKAAFSPTNLLEGVELSDDKMLQGRANIYSDSQRYRIGPDFRNVPVNNQSNWWPGDLVTSGDGRFVEGELQRSDIEKQDDFTQPGLFYESLSEEDKEDLITNMAEGLSVVSNDVFNTVHGYIQEASRDLANRLNKTVILKRKK

SEQ ID NO: 19742 - protein, 232 aa, Triticum aestivum
  unsure (1)..(232): unsure at all Xaa locations
DGLRGFAGGFGASLAGTVPARAQEXAALLXHPSPSAVASAAAGVSAAVAAQVVXAPVIRISQRRTVQTSAACRYAGGADAFRKILAADGVRGLYRGFGLSIITYAPSNAVWWASYAMAQRFAWRVVGADRSESYPALMAVQGASAAVAGGAAVLVTMPLDTGKTRLGVMETDAAVARPTLGSTVRGLLKEGGWAACYRGLGPRWGSMSLSAATMVTTYELLKRMSAKEGSLG

SEQ ID NO: 19743 - protein, 216 aa, Ophioglossum pedunculosum
SKRRNGLLKKAYELSVLCDAEVAVIVFSGTGKLSEFASSSMMRRILEKHRQVVEGSQSIKPTSQDVVEYWRHEATRLKHQLGVVQETQRHMLGESLETLTYRDLQKLESKLNGALNQVRGRKNQIISERLVYLQEKEDLLNAENIMMRAKLAEIMAGGVPLMSQSMQDPAARESFLNESSTQPNPPIMKNQNGEETNLQLGLELFPTTSFGDGAST

SEQ ID NO: 19744 - protein, 716 aa, Pseudomonas syringae pv. tomato str. DC3000
MASKKAPPATDTSKSQMAGTDTPDRGNTNAKLESLEQFRSDATGQALRTNHGVKISDNQNTLKVGSRGPSLLEDFIMREKITHFDHERIPERIVHARGTAAHGYFQTYENHGALSKAGFLRDPAEKTPVFVRFSTVQGPRGSGDTVRDVRGFAVKFYTGEGNFDLVGNNMPIFFIQDAIKFPDFVHAVKPEPHNEIPTGGSAHDTFWDFVSLVPESAHMVLWTMSDRAIPKSLRTMQGFGIHTFRLINTEGKSSFVKFHWKPKFGVCSLVWDEAQKLAGKDTDFHRRDLWESIEMGDYPEWELGVQIVAEEDEHKFDFDLLDPTKIIPEELVPVTPLGKMVLNRNPDNYFAETEQVAFCPGHIVPGIDFSNDPLLQGRLFSYTDTQISRLGGPNFHEIPINRPIAPNNNGQRDAQHRTTIDKGRASYEPNSIDGGWPKETPAAAVDGGFETYPERVEAHKVRERSESFGDHFSQATLFFQSMSHHEKEHIIAAYSFELGKVEREYIRARQVNEILANIDLELASRVAANLGLPAPTAGTVPVRNTSVKESPALSQVNLLSGDIVSRKVAILVANGVDGKAVEAMKKELTAKGAHAKVLGPTSAPVKTADGASLPVDASAEGLPSVAFDAVFVPGGKDSVKALSTDGVALHFILEAYKHLKAISVAGEAKELLTLLRLEEDAGLLVVSDSKSFETFFNAIAQHRVWDREVKAKAVPA

SEQ ID NO: 19745 - protein, 339 aa, Leuconostoc mesenteroides subsp. mesenteroides ATCC 8293
MTVKIGINGFGRIGRLAFRRILELSDKASDIEVVAINDLTSPDMLAYLLKYDSIHGTLNAEVSSDDTGIVVNGKHYAVYSERNAADLKWVANDGVDYVLEATGFYTSAEKSQAHLDAGAKKVLVSAPAGAVPTVVYGVNQDILTADDKIVSAGSCTTQSLAPIANVLEQEFGVKTGLMLTVHAYTASQSLQDGPKSAKFAKRQANRDAASNSLPHSSGAAKAIGMVVPSLDGKLTGSAIRVPVPDGSITELTAVLKKDVTVEEVNAAMKKYESDSFGYNGDGLVSTDIINDTHGTVFDPTQTEVVAGEGQQLVKVAAWYDNEYGFTSNMIRTLLHFATL

SEQ ID NO: 19746 - protein, 305 aa, Pichia jadinii
MATEKKQSTFLIDFLMGGVSAAISKTAAAPIERVKLLIQNQDEMIKQGRLAKRYDGIADCFRRTAGDEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 19747 - protein, 241 aa, Zea mays
CREFKEKTKVDKVVVLWTANTERYSNVVAGLNDTMDNLLASLDKNEAEISPSTLYAIACVFEGVPFVNGSPQNTFVPGLMELAIKKNSVIGGDDFKSGQTKMKSVLVDFLVGAGIKPTSIASYNHLGNNDGMNLSAPQVFRSKEISKSSVVDDMVASNPILYKPDEHPDHVIVIKYIPYVGDSKRAMDEYTSEIFMGGKNTIVLHNTCEDSLLASPIILDLVLLAELSTRIQLKAEGQVNR

SEQ ID NO: 19748 - protein, 501 aa, Glycine max
MGSAAKYELPFKLNNPDLLHNESFVHGKWVKSKSGKTFEVADPGTGKTWIDCPTNDASDVDEAVKSSHECFLEYKKISPRQRAQMLYKWDALIKENREDIATILVYETGKPRAEAYGEIDYSTGFTWWFAGEAERIQGSVFTPALPNRRIFTIKQPLGVAAALVPWNFPIAMILRKAGAALAAGCTMIVKPSPETPITVLALAYLADKAGFPKGALNVLTTDLDKTPELSEALCRHPLVNKVTFTGSTRVGKLVAKICSDNLKKVTLELGGNCPVLIFDDANIEQAMSQVFALKFRHAGQACITANRIYVQSGIFDKFLERWNAEAQKIVVGHGSDEKTTMGPVTTPRAVDKALSLVEDARKKGAKIHTGGNKVEKNGGYFFEPTVITGVTPDMDIAKEEVFSPISTFIKFETEDEVVKAANDTSMGLASYLFTKNVDRMWRLFENLEAGMIGLNTGNSSAAESPFGGIKQSGYGKESGKDVAVNEYMITKTGTFTLEDQS

SEQ ID NO: 19749 - protein, 243 aa, Zea mays
  unsure (1)..(243): unsure at all Xaa locations
MGRGRVELKRIENKINRQVTFAKRRNGLLKKAYELSVLCDAEVALIIFSNRGKLYEFSSTQSMPKTLEKYQKCSFAGPETALQNRENEQLKSSRNEYLKLKARVDNLQRTQRNLLGEDLESLGIKELEHLEKQLXDSSLKHIRSTRTQHMVDQLTELQKKEQMFCEANKCLRRRLXESNQVIWQHAWEQSERXHSEVQPQQLNGNNFFPSPRWVLVNPPLQIGYPSEALTSSCMTTFLPPWLP

SEQ ID NO: 19750 - protein, 555 aa, Thermobifida fusca
MLGRGGRLPPGKCRVGPAHWPSRLSSAEVSPTTRALSRHTGTSGPAPSRSLPAISTIKETDLTETNEALSTASNATGSTLDSGAPAASDRNSLSVGSNGPLLLHDVRLVETLAHFNRERVPERNPHAKGAGAFGVFETTEDVSQYTKAALFQKGARTEMLARFSTVAGEQGSPDTWRDVRGFALKFYTSEGNYDLVGNNTPIFFVRDPMKFPHFIRSQKRMPDTGLRDNNMQWDFWTLNPETAHQVTYLMGDRGLPRTWRHMNGYGSHTYMWINAKGEKFWVKYHFKTDQGIENMTNEEAERLAGVDADFHRRDLVEAIERGDYPSWTLYVQVMPYEDAKTYRFNPFDLTKVWPHSDYPLIKVGKMTLNRNPENFFAEIEQAAFAPSNLVPGIGVSPDKMLLGRVFAYADAHRARIGTNYFQLPVNKPRVKVNSYTFDGHMTYEHSGKAPVYAPNSYGRPWSDQTGPVEDSWEADGELVRSAYELHAEDDDFSQAGTLVREVFDDAQRDRLVETVADHLSKGVVEPVLSRAFQYWKNIDETIGERIEKRYHEIAR

SEQ ID NO: 19751 - protein, 474 aa, Glycine max
MRKFTTIFSHIKSTKMNFSVSLLHRSSPFCPNQPPHPNFKNLTWQNRDSLLLFPLLCSRHFASTTAQNPSTLNALQDHYQAIDFPGGAVQFIPEMRFISESPKERIPCYRVLDDNGQPILGHNFVQVSKEVAVKMYTDMVTLRSMDTIFYEAQRQGRISFYVTAIGEEAINVASAAALAMDDVVFPQYREAGVLLWRGFTLQEFANQLFSNIYDYGKGRQMPAHYGSKKHNYFTVASTIATQISHAVGAAYSLKMDKKDACAVTYFGDGGSSEGDFHAALNFAAVLEAPVIFICRNNGWAISTPISDQFRSDGVVVKGQAYGVRSIRVDGNDALAIYSAIQAARQMAITEERPILIEALTYRVGHHTTSDDSTKYRPANEIEWWRVARDPVVRFRKWIEKHGWWNDMAESELINNLRQQLLHTIQEAEGVEKPPLADSFSDVYDVAPSNLREQEQWLKEIVRKQPQEYPTNISV

SEQ ID NO: 19752 - protein, 365 aa, Pinus sylvestris
CQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADRPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 19753 - protein, 293 aa, Bacillus subtilis subsp. subtilis str. 168
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPTRNEVEELLS

SEQ ID NO: 19754 - protein, 615 aa, Legionella pneumophila
MKSTDPIKIAVLPGDGIGIEVTEATLPVFEVLDVPVILNYGDIGWEFWKKEGAAIPSRTWQLIASSDTVLLGAITSKPQREAKQELSNALKKSNPYYVSPVIQLRQGLDLFANVRPCFSIDDQSKPFNFCIIRENSEGLYCGFDYFPLPKAIHSLLAESQHWQTIPADEASCALRLQSKSGLTRLFDFAFKHAMQTGMPRVTLADKPNVLRESGEFTRKIFESTAQRYPKIQADILNVDAVALWLIKSPEKFGVIVAENMFGDILSDVGAGVMGGLGLAPSANIGDKGSYFEPVHGSGPRIRKNCANPSAMFLTISMLLNHFGYPDRAKKIVNAVMQVIKEKRFITYDLGGHATTTDMANAVIEHCARLNASCLSKDFNPTPKENLIESDTMPNLLQQLINCNSAEISDALDACGIEGGLLSIKPLSQGMKIIGPAYTIQYLPREKKGTAFHNAANYIDKVPKHSVIVIDNNGQIDCTVWGDLLTHTALRNNIMGTVVHGAVRDVESIRSTNYPVFCTGIYMCSGKNRVYKANEQCPLSINGVTINPGDIIFADDNGVLVIPNDRLQEVVNKTIAIRLTEERIKTAIASGSTLEQAREDYCYEQPWLGINKKRES

SEQ ID NO: 19755 - protein, 338 aa, Zea mays
MGCSISGLNALYDAATGGGDVWINERRFRVLRQIGEGGFAFVYLVREHQPASDAAFARRDPAHVSEDGTYAMKKVLIQSKEQLDLVREEIRVSSLFNHPNLLPLLDHAIIAVKSQQGDWSHEAYLLFPVHLDGTLFDNANIMLSRREFYSTADVLQIFQQMCEGLKHMHSFDPPYAHNDVKPGNVLITWRKGQAPVATLMDFGSARPARKEIRSRSEALQLQEWAAEHCSAPYRAPELWDCPSHADIDERTDIWSLGCTLFAIMYNVSPFEYALGESGGSLQLAIVNGQLKWPAGPKPPYPDELRHFVIWMLQPEAVMRPHISDVVLHVDKLIAKYLP

SEQ ID NO: 19756 - protein, 276 aa, Mycobacterium leprae
MFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCGVALNAFNPGQAFEIVLSVAALGIIAGWGTIVLCQLRLHKMAKAGIMRRPRFRMPLAPYSGYLTLAFLFAVLVVMAFDKPIGTWTVASLIVIVPALIAGWYSIRKRVMTIARERMGYTGPFPAIANPPVQPSERSHSQNP

SEQ ID NO: 19757 - protein, 457 aa, Meristotheca procumbens
  unsure (1)..(457): unsure at all Xaa locations
EYVVKETDVLALFRVSPQPGVDPIEASAAVAGESSTATWTVVWTDLLTACDLYRAKAYKVDAVPNTSDQYFAFIAYDIDLFEEGSIANLTASIIGNVIXXXXXXXXXXXXXXXPLAYLKTFQGPATGLVSERERMDKFGRPFLGATVKPKLGLSGKNYGRVVYEGLKGGLDFLKDDENINSQPFMRWKERFLYAMEGVNRSIAATGEVKGHYLNVTAATMEQMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 19758 - protein, 349 aa, Emericella nidulans
MCIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPVDAAAPVLCAGITVYKGLKEAGVRPGQTVAIVGAGGGLGSLAQQYAKAMGIRVVAVDGGDEKRAMCESLGTETYVDFTKSKDLVADVRHGRGCLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 19759 - protein, 503 aa, Glycine max
MSSTTQNRRSSFTPSTASSLAKAKRHPSSVSSSSSGKAKVVSTQNLAVKRAPLANLTNQRNAPYSSSSSSLVQGSNKVAKTKKEAPARTSVSKSTISGNKSSQLKSVNSSSVVIPKANSLSQKKDAAPTVATFAVPVRSGIDVSPSKSDGRFVSMDETTSSCDSIKSPDEVEYLDNRDVSDVDSIQKKIISNLNISDTTEPEGNVCSREIIVELEERVDKIVNIDNIYSDTQLCATYVCDIYKHLRESEEKKRPSTDFMDTIQKDINVSMRAILVDWLVEVAEEYRLVPETLYLTVNYLDRYLSGNAMNRQRLQLLGVSCMMIASKYEEICAPQVEEFCYITDNTYLKEEVLQMESAVLNYLKFEMTAPTVKCFLRRFVRAAAHDVQEIPSLQLEYLTNFIAELSLLEYSMLSYPPSLIAASVIFLARFILFPSKKPWNSTLQHYTLYRPSDLCACVKDLHRLCCSSHDSNLPAIRDKYSQHKYKCVAKKHIPPSIPQEVFQS

SEQ ID NO: 19760 - protein, 258 aa, Rhodospirillum rubrum
MNARLWIGTSWKMHKTIAEAEAYVGELTASPLLDRVEAFIVPPFTALAAVHRALGDAPVHLGAQTMHWQDEGAQTGEISPLMLRDCGVGIVELGHSERRASHGETDATVNAKVASALRHGLRPLICVGDQGDDLDAGASIETVLRQVKLAIKGIDTASLGRALIAYEPVWAIGEAGRPAEPAHVAEVHGALRAMLGQRGLAALPLLYGGSVDRANAGALTALANVDGLFVGRAAWTARGFEEVIEAALHGAKDRAGLA

SEQ ID NO: 19761 - protein, 485 aa, Pseudomonas fluorescens PfO-1
MVTSNNKTRKSPMPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 19762 - protein, 452 aa, Rhodospirillum rubrum
MTESNSLGGRFRRYARVSTAMGGIAARAAGEKYLGFKGDRARMASDLREALGGLKGPLMKVAQIMSTIPDALPQEFTAELTQLQADAPRMGWPFVKRRMTAELGPNWLGRFASFDHDAVAAASLGQVHRAIHLDGRALACKLQYPDMDSTVEADLSQLKIIIGLYRRYDGAIDPTEIHAEITERLREELDYAREARNMRLYRHMLRDEAGVHVPEPIADLSTKRLLTMTWLQGERLLTFINHSPEERNHLAYNMFRAWYVPFYDYGVIHGDPHLGNYTVREDFSVNLLDFGTIRVFRPVFVQGVIDLYIALRDNDQERAVHAYDCWGFRDLSKDTIAVLNQWAKFIYGPLLEDRVRNIQEDLPMGGNQGRQVAEKVHQDLKAIGGVTPPREFVLMDRAAIGLGSVFWHLKAEINWFQMFHELIDNFDVDALARRQTEALTGVGLVPSDLGVG

SEQ ID NO: 19763 - protein, 175 aa, Triticum aestivum
  unsure (1)..(175): unsure at all Xaa locations
MAPAVMASSATTVAPFQGLKSTASLPVSRRSSGSLGRVSNGXGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 19764 - protein, 431 aa, Salmonella typhimurium
MVSLEKNDRVMLARQLPLKSVALILAGGRGTRLKDLANKRAKPAVHFGGKFRVIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPAMLGDASKSLASMGIYVFDADYLYELLAADDKDDASSHDFGKDIIPKITREGMAYAHPFPLSCVQSDPQAEPYWRDVGTLEAYWKANRDLASVTPQLDMYDQNWPIRTHMESLPRAKFVQERSGSHGMTLKSLVFGGCIISGSVVVQSVLFPRVRINSFCNIDSAVLLPEVWDGRSCRLRCCVIDRACIIPEGMVIGENAEEDARRFYRSEEGIVLVTREMLRKLQGHKQER

SEQ ID NO: 19765 - protein, 374 aa, Triticum aestivum
  unsure (1)..(374): unsure at all Xaa locations
PRHPEHLISCSTISISRGALADCCSFLLLEISVGCAAPIKIGINGFGRIGRLVARVALQSPDVELVAVNDPFITTDYMTYMFKYDTVHGQWKHHEVKVKDSKTLLFGQKEVAVFGCRNPEEIPWAAAXGLSTVVESTGVFTDKDKAAAYIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAXGIALNDNFVKLVSWYDNEWGYSTRVVDLIRHMHSTK

SEQ ID NO: 19766 - protein, 521 aa, Glomus intraradices
MSTSDRVTIDVDKRRAALKEIDDAKFGWQHIRACLVAGTGFFMDAYDLFAINFASTMIGYVYYGGKTPANIDLGLKVSGSIGTLLGQLFFGYLADRLGRKKMYGVELMIIIVATVASSLAGQSRAVTVVGIIMFWRVVMGVGIGGDYPLSAIITSEFATKKRRGAMMASVFAMQGFGILGSAIVALIVLAAFRSAIIADVSAVDYCWRIVLGCGAIPGIAALYFRLTIPETPRYTMDVEHDVNKATSDVANYLQKTDTTDENDGPGNHVGVPKASWSDFTSYFGKWKNGKVLLGTSMSWFALDIAFYGIGLNNGIILSAIGYADTHDADFNLRAYNSLKNMALGNIIITIMGTVPGYWVTVAFVDKWGRKPIQIMGFAVLTVLFIVMGAAFNPLKEHSIPAFIVLFTLLQFFQNFGPNTTTFIVPGEVFPTRYRSTGHGISAASGKLGAIVAQVGFSKLKDIGGPNAFVGQLLLIFAAWMFIGGLFSILIPETKGLSLEELANEDHDFNVEERKERVKAEA

SEQ ID NO: 19767 - protein, 120 aa, Triticum aestivum; identical to SEQ ID NO: 15182

SEQ ID NO: 19768 - protein, 474 aa, Zea mays
  unsure (1)..(474): unsure at all Xaa locations
MDMALASKASPPPSNATAAEQXIPKXXXXXXXXXXXXXXXXXXSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKVFQTDVPTVKNINLDFSLGYYIILDMPFCPLIFNIYF

SEQ ID NO: 19769 - protein, 498 aa, Nostoc sp. PCC 7120
MKTPLNCQNYINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVYVDFSGSLQRAQIDNRS

SEQ ID NO: 19770 - protein, 436 aa, Actinobacillus pleuropneumoniae serovar 1 str. 4074
MAKIVKVIGREIIDSRGNPTVEAEVHLEGGFVGLAAAPSGASTGSREALELRDGDKSRFLGKGVLKAVSAVNNEIAQAILGKDGSAQAEIDQIMIDLDGTDNKSKFGANAILAVSLATAKAAAASKGLPLYAYIAELNGTPGVYSMPLPMMNIINGGEHADNNVDIQEFMIQPVGASTLKEALRIGAEVFHNLAKVLKSKGLNTAVGDEGGFAPNLASNADALACIKEAVEKAGYVLGKDVTLAMDCASSEFYNKENGLYEMKGEGKSFTSQEFTHYLEGLCNEYPIKSIEDGQDESDWEGFAYQTKVLGGKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALAAAGTPAPFNGLKEVKGQA

SEQ ID NO: 19771 - protein, 407 aa, Oryza sativa; identical to SEQ ID NO: 7368

SEQ ID NO: 19772 - protein, 860 aa, Aspergillus kawachii
MRFTLIEAVALTAVSLASADELAYSPPYYPSPWANGQGDWAQAYQRAVDIVSQMTLAEKVNLTTGTGWELELCVGQTGGVPRLGVPGMCLQDSPLGVRDSDYNSAFPSGMNVAATWDKNLAYLRGKAMGQEFSDKGADIQLGPAAGPLGRSPDGGRNWEGFSPDPALSGVLFAETIKGIQDAGVVATAKHYIAYEQEHFRQAPEAQGYGFNISESGSANLDDKTMHELYLWPFADAIRAGAGAVMCSYNQINNSYGCQNSYTLNKLLKAELGFQGFVMSDWAAHHAGVSGALAGLDMSMPGDVDYDSGTSYWGTNLTVSVLNGTVPQWRVDDMAVRIMAAYYKVGRDRLWTPPNFSSWTRDEYGYKYYYVSEGPYEKVNHYVNVQRNHSELIRRIGADSTVLLKNDGALPLTGKERLVALIGEDAGSNPYGANGCSDRGCDNGTLAMGWGSGTANFPYLVTPEQAISNEVLKNKNGVFTATDNWAIDQIEALAKTASVSLVFVNADSGEGYINVDGNLGDRKNLTLWRNGDNVIKAAASNCNNTIVIIHSVGPVLVNEWYDNPNVTAILWGGLPGQESGNSLADVLYGRVNPGAKSPFTWGKTREAYQDYLVTEPNNGNGAPQEDFVEGVFIDYRGFDKRNETPIYEFGYGLSYTTFNYSNLEVQVLSAPAYEPASGETEAAPTFGEVGNASNYLYPDGLQKITKFIYPWLNSTDLEASSGDASYGQDSSDYLPEGATDGSAQPILPAGGGPGGNPRLYDELIRVSVTIKNTGKVAGDEVPQLYVSLGGPNEPKIVLRQFERITLQPSEETKWSTTLTRRDLANWNVEKQDWEITSYPKMVFVGSSSRKPPLRASLPTVH

SEQ ID NO: 19773 - protein, 468 aa, Phaeosiphoniella cryophila
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYQGLAGGLDFLKDDENINSQPFMRWKERFLYCMEGVNRAAAATGEVKGSYLNVTAATMENMYERAEYSHAIGSVICMIDLVVGYTAIQSMAIWARKAEMILHLHRAGNSTYARQKNHGINFRVICKWVRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFDYTSTDTPDFVEVATESN

SEQ ID NO: 19774 - protein, 325 aa, ASPERGILLUS NIDULANS FGSC A4
MLAGGIGDTVKTRQQGDPHIPPRYTSMTSSYATIYRQEGLLRGLYGGVTPALMGSFPGTLIFFGVYEFTKRKMLDAGINANVAYLSGGFFADLAASVVYVPSEVAKTRLQLQGRYNNPYFKSGYNYRSTADAFRTIVRQEGFSALFYGYKATIFRDLPFSALQFAFYEQEQRIAKEWVGSRDIGLGLEIFTAVTAGGMAGVLTCPMDVVKTRIQTQQNPAPNSAPAPNASVVREAKSGVQSQSRSISATAAAASPTPSGALRLDNSSFFTGLKMIYKTEGIGGWFRGVGPRGVWTSIQSGTMLVLYQYLLKQFEAFGEAEDTNPL

SEQ ID NO: 19775 - protein, 322 aa, Zea mays
  unsure (1)..(322): unsure at all Xaa locations
MASRLVYPVCHNICPEKSYCSCTGVVRPSCDLPKKKKKKKKKKKKKPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDFIKVSDDEVAFLTRGDANDEKNVLSLWFDGXKLLVVTDGDKGCRYFTKDFKGSVPG

SEQ ID NO: 19776 - protein, 442 aa, Glycine max
  unsure (1)..(442): unsure at all Xaa locations
MANALHNAAISRVMFGDQYSISRCVVPSLSTLPLRAMHKGKHVELNRTVMVVKAKTNSDFDDSDVDISLSHRVNAVKLSKTLSICDHATALLQAGVPVIRLFFGESDFDTPGAIAEAGMNAIREGYTRYTPNAGTLELRQAICHKLKEENGITYSPDQIVVSNGAKQSIVQAVLAVCSPGDEVIIPAPFYVSYPEMARLAHATPVILPSHISRSVYSKKLLEEIAQIVAKHPRLLVLSDENYEHIIYAPATHTSFASLPGMWDRTLIVNGLSKTFAMTGWRLGYIAGPKHFVAACEKIQSQFTSGASSISQKAGVAALGLGYAGGEAVSTMVKAFRERRDFLVESFREMDGVKICEPQGGFYVFLDFSSYYGREAEGFGVIENSDSLCRYLLDKGLVALVPGXAFGDDTCIRISFAESLTTLKTAVERIKKALIPLSSSALV

SEQ ID NO: 19777 - protein, 204 aa, Zea mays
  unsure (1)..(204): unsure at all Xaa locations
MEDEEHEVYGQEIPVDGEDVDMAAGDDATKLQELDDMKRRLKEMEEEAAALREMQAKVAKEMQGVDPNATTSENKEEMDSRSVFIGNVDYAXCTPEEVQQHFNSCGTVNRVTILTDKFGQPKGFAYVEFVEVEAVQEAIKLNESELHGRQLKVAPKRTNVPGMKQPRGRGFNPYHGHPYMRPYGYSPYGYGEXPRFRRPRRPYF

SEQ ID NO: 19778 - protein, 540 aa, Solanum tuberosum
MANDLQVLNALDVAKTQLYHFTAIVIAGMGFFTDAYDLFCISMVTKLLGRIYYHHDNALKPGSLPPNVSAAVNGVAFCGTLAGQLFFGWLGDKMGRKKVYGMTLMIMVICSIASGLSFGHTPKSVMTTLCFFRFWLGFGIGGDYPLSATIMSEYANKKTRGAFIAAVFAMQGFGILAGGMVAIIVSSAFKGAFPAPAYEVDALASTVSQADFVWRIILMFGAIPAGLTYYWRMKMPETARYTALVAKNLKQAANDMSKVLQVEIEAEPEKVGAISEAKGANEFGLFSKEFLRRHGLHLLGTASTWFLLDIAFYSQNLFQKDIFSAIGWIPPAQTMNALEEVYKIARAQTLIALCSTVPGYWFTVAFIDRIGRFAIQLMGFFFMTVFMFALALPYHHWTLKDNRIGFVVMYSLTFFFANFGPNATTFVVPAEIFPARLRSTCHGISAAAGKAGAMVGAFGFLYAAQPTDPKKTDAGYPPGIGVRNSLIVLGCVNFLGMLFTFLVPESNGKSLEEMSRENEGEEETVAEMRATSGRTVLFKF

SEQ ID NO: 19779 - protein, 753 aa, Escherichia coli K12
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDFVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 19780 - protein, 272 aa, Glycine max
PRVPLPTPPIKPHSEPKVWNFFKLPFRHSATTNTTPSSANLHHLHHHHHNHHHNPNNNLPLEGSTSNTSNSVSSVARSLLPTRRRLKLDPSNKLYFPYEPGKQVRSAIRIKNTSKSNVAFKFQTTAPKSCFMRPPGAILAPGESIIATVFKFVEQPENNEKPEKTGLKFKIMSLKVKGLIDYVPELFDEQKDQVAVEQILRVVFLDPERPCPALEKLNRQLADADAALEARKKPAEDAGPKIIGEGLVIDEWKERRERYLAKQQGEVAVDSV

SEQ ID NO: 19781 - protein, 403 aa, Glycine max
  unsure (1)..(403): unsure at all Xaa locations
ASDGFTDKNTVFRKLKAKSENKMCFDCNAKNPTWASVTYGIXFLCIDCSAAHPSLAVHINFVRSTNLXSWRTDQLXRYALAQIFFKILSLNNXGLTERLSIHLEQKSRTGEMYRKXLSKEVARRXAEDGGLPSSPVASQSAQGIRSQDEGSTNKKPSENTLEKPEKPESTSSPRASHSVISSTXKKPIGAKKAVKSGGLGARKLTKKPSEXLYEQKPEEPPAPVNNMPAGPSPTSPLTSRFEYVENVQSSELNTGGSHFLSHVSPPKSSSFFADFGMDGGFPKKSGPSSSKVQIQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 19782 - protein, 279 aa, Thermoproteus tenax
MGDGGALAHVAESLNISGAVMVVNGDVFTDADYRAVLDAHKRAGGVATMMLVEVSPESVSKYGIAVLDDSMRLIEFVEKPKEPPAGSRLANAGIYVFEPEVFKLIPRRRGEVKIAKDIIPELLRRGDIYAFIHRGIWHDIGTPADYLKANYAALDKWGSKEVDKPGIDITPPVYIGEGSIVEEGASLGPYVVLGQGAKVGRYARLKNSVLMRAATVEPGAYISGSIIGEETYIGRWARVLESVVADGVYIKDEVYVGRGSAIGPNREVVEDVPDGSMLP

SEQ ID NO: 19783 - protein, 302 aa, Thermoanaerobacterium thermosaccharolyticum
MKGIILAGGSGTRLYPITKAISKQIVPIYDKPMIYYPLSVLMLSGIRDILIISTPRDIDTFKELFGDGSQLGLHFEYAIQEVPRGLADAFIIGEKFIGKDNVALVLGDNIFYGYGFTERLERAASRKEGATIFGYHVSNPSDFGVVEFDDNFNVISIEEKPKYPKSNYAVPGLYFYDNDVIEIAKNVKPSARGEIEITSVNNEYLRRGKLKVELLGRGMAWLDTSTPAGLLNAANFVEAIQTRQGLYVACIEEIAYRKGYIDKEQLIKLAEPLKKVEYGKYLLNLLNDENTVQEVAAANVGL

SEQ ID NO: 19784 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 19785 - protein, 405 aa, Triticum aestivum
  unsure (1)..(405): unsure at all Xaa locations
AFTSLVYPALILGYMGQAAYLTKHHDFDSSYQIGYYISVPEAVRWPVLVLAIMASVVGSQAIISGTFSIINQSQALSCFPRVKVVHTSAKVHGQIYIPEINWMLMVLCIAVTVGFRDTKHMGNASGLAVITVMLVTTCLTSLVMMLCWHRPPVLALAFFVFFGSIEALYFSASLTKFLDGAXVPLLLALILVAVMFVWHHTTLKKYEFDLHNKVTMEWLLALCDRLGMVRVPGMGLVYTDLTSGVPANFSRFVTNLPAFHRVLVFVCVKSVPVPRVLPAERYLVGRVGPPGHRSYRCIVRYGYRDVHQDVDSFETELVESLASFIRLDALFRCSDARSDADYERENAFTVIGSNPLRRRISYDDTHDSASSVEIRVDSPTGSSRTNTIQLDAVSRPRACDRVTLL

SEQ ID NO: 19786 - protein, 357 aa, Triticum aestivum
MAGIRLTPEEPELPQGTPPRPQLPLPVAGSGVTAGGGGSGGLEMASDDERSVAADSWSVRSEYGSTLDDDQRYADAADVLAAAAAAGNFPSAASDYCSDKDDQDPNEEGSMLGLQSYWDASYSEDLANFQEHGHAGEIWFGADVMDTVAIWTKKLCVSFFQGGLSSANDNIKFEVDDKHLFDYPVLDLGTGNGLLLQALAKQGFSDLTGTDYSEGAIELARNLAARDGFTTISFLVDDVLETKLDRKFKIITDKGTLDAIGLHPDGRAKRVMYWESISNLVEPGGLVVITSCNHTKDELLQEVEEFGMRKFGKEDTDRGAGDSHQIFRYLDHVQTYPTIMFGGVEGSQVCTLAFQRA

SEQ ID NO: 19787 - protein, 209 aa, ASPERGILLUS NIDULANS FGSC A4
MVRKDPIFEARTNVKLHSNRLKKEAARAEATFKSEKAKADKAMKNREFQIARIHASSAVREKRRQVTLKAEAARADVIINELKAAQSTRDTSRTLALASRGLDAASKSVNLETLVSHANNFLARSEDFKIASNAIEDVAQGVSMQEYGAEGEADVDRLMEQLADDAGVDLRLALEQDSAPKEDVKEQTKVDADVEDGLGARLRALRAAN

SEQ ID NO: 19788 - protein, 540 aa, GIBBERELLA ZEAE PH-1
MRLSTSALVLGAASSAMGLEQQILGGDSKPLIDLDVNAWTKPLEKFFGEISSEAKAVWDEVTLLAPDAVEAFKKQVLTEPKKVNRRPDSHWDHVVKGADVQSLWTEKNGEKHREVGGKLENYNLRAKKVDPSKLGVDKVKQYSGYLDDEEEDKHLFYWFFESRNDPKNDPVVLWLNGGPGCSSLTGLFLELGPASVNKKIEIVNNPESWNNNASVIFLDQPVNVGYSYSGGSVSNTVAAGKDIYALLTLFFHQFPEYAKQDFHIAGESYAGHYIPVFANEILSHDDRNINLKSVLIGNGLTDGYTQYAYYRPMACGDGGYPSVLSESECQSMDNALPRCQSLIKGCYESGSAWSCVPASIYCNNAMMGPYQRTGQNVYDIRGKCEDGNNLCYSGLGYIADYLNREEVKEALGAEVSSYDSCNMDINRNFLFAGDWMQPYHQLVPNVLDKIPVLIYAGDADFICNWLGNQAWTDKLQWSGQKDFSHADLKPLKHAGKEYGKVKSSGNFTFMQIYGAGHMVPMDQPEASSDFFNRWLSGEWF

SEQ ID NO: 19789 - protein, 199 aa, Glycine max; identical to SEQ ID NO: 4688

SEQ ID NO: 19790 - protein, 488 aa, Vaucheria repens
MSKSVQERTRIKSQRYESGVIPYAKMGYWDAFYNVKHTDVLALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEVKGSYLNTTAGTMEEMYERAEYAKQIGTIIVMIDLVIGYTAIQSMAIWARKADMILHLHRAGNSTYARQKNHGINFRVICKWMRMAGVDHIHAGTVVGKLEGDPLMVKGFYNTLLETKLEINLPQGLFFEMEWAALRKTVPVASGGIHCGQMHQLLYYLGDDVVLQFGGGTIGHPDGIQAGATANRVALEAMVLARNEGRDYLNEGPQILRDAAKTCGPLKTALDLWKDITFDYTSTDTPDFVETATQSK

SEQ ID NO: 19791 - protein, 353 aa, Rosellinia necatrix
MGCGMSTEEKEGKARNEEIENQLKRDKMMQRNEIKMLLLGAGESGKSTILKQMKLIHEGGYSRDERESFKEIIFSNTVQSMRVILEAMESLELPLEEPRMEYHVQTIFMQPAQIEGDVLPPEVGGAIEALWKDHGVQECFKRSREYQLNDSARYYFDNIVRIATPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 19792 - protein, 221 aa, Zea mays; identical to SEQ ID NO: 5870

SEQ ID NO: 19793 - protein, 471 aa, Astragalus membranaceus
MATATATDRLSNLKSSVAGLNQISENEKSGFINLVARYLSGEAQHVEWSKIQTPTDEVVVPYDTLAPTPDGSLEIKNLLDKLVVLKLNGGLGTTMGCTGPKSVIEVRDGLTFLDLIVIQIENLNSKYGSNVPLLLMNSFNTHDDTQTIVEKYQNSNIEIHTFNQSQYPRLVVDDFLPLPSKGRTDKDGWYPPGHGSMFPSLSNSGKLDALISQGKEYVFVANSDNLGAIVDLKILNHLVAHKNEYCMEVTPKTLADVKGGTLISYEGRVQLLEIAQVPDEHVGEFKSIEKFKIFNTNNLWVNLKAIKRLVEADALKMEIIPNPKEVDGVKVLQLETAAGAAIRFFDKAIGINVPRSRFLPVKATSDLLLVQSDLYTVENGSVIRNKARTNPENPSIELGPEFKKVSNFLGRFKSIPSIVELDSLKVVGDVWFGTGVILKGKVSIVAKSGVKVEIPDGAVIANKEINGPKDL

SEQ ID NO: 19794 - protein, 144 aa, Salmonella enterica
MPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 19795 - protein, 480 aa, Hypnea spinella
AGIKNERYESGVIPYAKMGYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERYLYSMEGVNRSVAATGEVKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 19796 - protein, 354 aa, Zymomonas mobilis
MAKATQDSNRPHKADVGSAIPNHDLPPIPGRYHADREELLEFYRRMLMIRRFEERCGQLYGLGLIAGFCHLYIGQEAVAVGLQAALQPGRDSVITGYREHGHMLAYGIDPKIVMAELTGRASGISHGKGGSMHMFSTEHKFFGGNGIVGAQVPLGAGLAFAHKYRNDGGCSAAYFGDGSANQGQVYEAYNMAALWKLPVIFVIENNGYAMGTSIQRANAHTALSERGAGFGIPALVVDGMDVLEVRGAATVAVDWVQAGKGPIILEMKTYRYRGHSMSDPARYRSREEVNDMKENHDPLDNLKKDLFAAGVPEAELVKLDEDIRQQVKEAADFAEKAPLPADEELYTNILVGKY

SEQ ID NO: 19797 - protein, 503 aa, Schizosaccharomyces pombe
MSTKLVDHVEITVPTGKTYIQPVGLFINNQHVDSVHGGRVKVYSPSTEKLICEVADADEEDVDIAVKVARAAFQTDAPWRKFSSAQRGRCLSRLADCIEQNLEYLASIETLDNGKSITLARGDVQAAADCFRYYGGWADKDYGQTIETDIKRFAYTRHEPIGVCGQIIPWNFPFLMCAWKIAPAVACGNTIILKTAELTPLSALCLTKFVPECGFPPGVINVLSGDGRRCGNAISSHMDIDKVAFTGSTGVGRMVMRAAASSNLKKVTLELGGKSPNIVFNDADLDSAAVWTNYGIFYNSGQVCCAGSRVYVQEDVYDEFIKRMVAKAKTLKVGDPFAEDTFQGAQVSKQQYERIVSYIESGIAHGAKLEIGGKRHGNLGYFVEPTILSNVTEDMAVGKEEIFGPVLAVIKFKTIEEAIRRGNNSTYGLAAGVHTNNITNAIKVSNALEAGTVWVNCYNLLHHQIPFGGYKESGIGRELGSYGLTNYTQTKAVHINLGMDSPI

SEQ ID NO: 19798 - protein, 181 aa, Arabidopsis thaliana
MASSMLSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 19799 - protein, 519 aa, Zea mays; identical to SEQ ID NO: 17309
  unsure (1)..(519): unsure at all Xaa locations

SEQ ID NO: 19800 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGAPWLKVKNPNTGKEIVIKDVIADAFLQQILLRPAEYDVIACMNLNGDYISYALAAQVGGIGIAPGANIGYECALFEATHGTAPKYAGQDKVNPGSIILAAEMMVRHMGWTEAADLIVKGMEGAINAKPVTYDFERLMEGAKLL

SEQ ID NO: 19801 - protein, 265 aa, Digitalis lanata
PTCGVKCLLEEEAIKVGGANHSHATQDLYDSIAAGNYPEWKLFIQTIDPDHEDRFDFDPLDVTKTWPEDILPLQPVGRMVLNKNIDNFFAENEQLAFCPAIVVPGVYYSDDKLLQTRIFSYSDTQRHRLGPNYLQLPANAPKCAHHNNHHEGFMNFMHRDEEVNYFPSRYDPCRHAERFPHPPVALNGKRDRICIEKENNFKQPGEKYRSFPPDRQERFIKRWVDALSDPRLTHEIRSIWVSYWTQADKSLGQKLASRLNIRPTM

SEQ ID NO: 19802 - protein, 446 aa, Zea mays; identical to SEQ ID NO: 8390

SEQ ID NO: 19803 - protein, 157 aa, Zea mays
MQLSFQFHTSSMTAETLCFGGDSTSTDRPASADPPPLLPIPRRGALRVPPSALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 19804 - protein, 369 aa, Oryza sativa; identical to SEQ ID NO: 16484

SEQ ID NO: 19805 - protein, 467 aa, Haraldiophyllum ramirezii
PYAKMGYWDPDYVIKETDVLALFRVTPQPGVDPVEASAAVAGESSTATWTVVWTDLLTACDLYRAKAYKVDAVPNTSDQYFAYISYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNITAATQEDMYERAEFAKQLGSVIIMIDLVIGYTAIQTMAIWSRKNDMILHLHRAGNSTYSRQKIHGMNFRVICKWMRMAGVDHIHAGTVVGKLEGDPLMIKGFYDTLLLPYLDINLPQGIFFTQDWASLRKVTPVASGGIHCGQMHQLLDYLGNDVVLQFGGGTIGHPDGIQAGATANRVALESMVIARNEKRDYVAEGPQILRDAAKTCGPLQTALDLWKDITFNYTSTDTADFVETPTANV

SEQ ID NO: 19806 - protein, 523 aa, Lycopersicon esculentum
MAGGGFTTSGNGGTHFEAKITPIVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLLPETKNVPIEEMTERVWKQHWLWKRFMVDEDDVDMIKKNGHANGYDPTSRL

SEQ ID NO: 19807 - protein, 125 aa, Triticum aestivum
  unsure (1)..(125): unsure at all Xaa locations
RVPRPADPCDRENFYPFPPFMSGLXYALSWDLXVRXVARSEVSRRDRVGPEDMWTGRWLNVACEAKNRYDGAPRMYNYLGSSPANCFRRGFRPDTIAVHMLEDACRXAETLAYFNATAALPPSGL

SEQ ID NO: 19808 - protein, 626 aa, Lilium longiflorum
MANSTVCWVVLCLLCWFSIGKAEYLKYKDPNQPLGARIRDLMKRMTLEEKIGQMTQIERKVGSAKVVKDYFIGSLLSGGGSVPAPKATAKEWVDMVNEFQKGALATRLGIPMIYGIDAVHGHNNVYNATIFPHNIGLGATRDPFLVKRIGAATALEVRATGIPYTFAPCIAVCRDPRWGRCYESYSEDHTIVQAMTELIPGLQGDLPANYRKGTPYVGGKDKVVACAKHYVGDGGTYEGINENNTIINSHGLFSIHMPAYYNSIIKGVSTVMVSYSSWNGKKMHANRALITGFLKNTLKFRGFVISDWQGIDRITSPPDANYTYSVQASIHAGLDMVMVPNNYTEFIDDLTLLVKKNVIPMSRIDDAVKRILRVKFVSGLFENPLADYSLTDQLGNKEHRELAREAVRRSLVLLKNGKPANQPLLPLPKNAPKILVAGRHANDIGLQCGGWTIKWQGEIGNITAGTTILEAIKATVDPTTDVVYKEKPDATFVKNNDFSYAIVVVGETPYAETAGDNLNLTLPAPGPSMIKHVCGVVKCVVVIISGRPLVIEPFLGSMDAVVAAWLPGSEGQGVSDVLFGDYGFTGKLPRTWFKSVDQLPMNVGDRHYDPLFPFGFGLTTSPITQS

SEQ ID NO: 19809 - protein, 164 aa, Zea mays
MADDGGSHEGSGGGGGVRERDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 19810 - protein, 364 aa, Nicotiana tabacum
MGSTSQSQSKSLTHTEDEAFLFAMQLASASVLPMVLKSALELDLLELMAKAGPGAAISPSELAAQLSTQNPEAPVILDRMLRLLATYSVLNCTLRTLSDGSVERLYSLAPVCKFLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKHPSIKGINFDLPHVIGDAPAYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTNN

SEQ ID NO: 19811 - protein, 82 aa, Viscum album subsp. album
GFAWSWGPLGWLIPSEIFPLETRSAGFFFAVSMNMFCTFLVAQAFLTMLCLMRSGIFFFFAAWIVVMGIFAIFFLPETKGIP

SEQ ID NO: 19812 - protein, 347 aa, Glycine max
MSDHEDHADYADNESFAKRRFRDRSKEALSKQAVKLAKQAEEHERFINKVTHLLGVLGFGWFCFIFGARPQAVPLVYCLFYVVFVPLRWIYYRFKKWHYYLLDFCYYANTIFLVYLLFYPSNEKLFLVCFSFAEGPLAWAIIVWRCSLVFSSVDKIVSVLIHLLPGLVFFTIRWWNPATFEAMHPEGTARRPTWPYVEDKSYLWTWLFLVPLVAYTLWQVLYFLIVNVLRRQRLLRDPEVMTSYRELSKKAQKANNIWWRLSGLLGDQNRMLMYIFLQGIFTVATMALTVPIFLSYELHVVFQILKVSASIWNGGSFLLEVMPRQAILKEKKKSEMQPVEEAQSNHQ

SEQ ID NO: 19813 - protein, 263 aa, Desulfitobacterium hafniense
MILPVGVPNFAEALRAGAEVFHALKSVLKGRGLSTAVGDEGGFAPDLRSNEEALETILEAIGKAGYKAGEDILLGLDVASTEFYDNGKYHLVGEGKRLTSEQFVDFLANWAAQYPIVTIEDGMAEDDWNGWKLLTDKIGNKVQLVGDDLFVTNPKIFAEGIDKGVANAILIKVNQIGTLTETLEAIAMADRAKYAAVVSHRSGETEDTTIADISVATTATQIKTGSLCRSDRVAKYNQLLRIEEQLGSAARYAGRDAFVSLRR

SEQ ID NO: 19814 - protein, 333 aa, Glycine max
MAYHHHDHTNRKSLLDTLYCSEAEEDYGHFLNNSSPASPPFLLQSDMFSDEQELTSLLGKEHHNPLSTCLQTNPALDFARREAVEWMLKVNSHYSFSALTAVLSVNYFDRFLFSFRFQNDKPWMVQLAAVACLSIAAKVEETHVPFLIDLQQVEESRYLFEAKTIKKMEILILSTLGWKMNPPTSLSFLDYFTRRLGLKDHLFWEFLTKSEGVLLSLIGDSRFMSYLPSVLATATMMQVLKSVEPSLEAEYKSQLFGILRIDKEKVNSCCKLMLELWSEFEGKQCMKRKFGIGWIPGSPNGVMDVSFSCDSSSNDSWVSSSPEPLSKKSRSEK

SEQ ID NO: 19815 - protein, 299 aa, Corynebacterium glutamicum ATCC 13032
MTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 19816 - protein, 115 aa, Glycine max
  unsure (1)..(115): unsure at all Xaa locations
RFLPVKATSDLLLVQSDLXTLVDGYVIRNPARVKPSNPSIELGPEFKKVANFLARFKSIPSIVELDSLKVSGDVSFGSGVVLKGNVTIAAKAGVKLEIPDGAVLENKDINGPEDL

SEQ ID NO: 19817 - protein, 221 aa, Escherichia coli
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAILTSQTTKKSLMKCAVNWQR

SEQ ID NO: 19818 - protein, 425 aa, Oryza sativa
MLSMVKGFASTCKGSNWRYREMGGALNKFTSTLETAALSLLWEPLLVKQLACCMNQPCNDEQYAFRNMHKKEHAKKLKQCNHSCNYENIGCLLRPFDGYVLFPIFAVSFFSDNLSGYGYLDEQFNQLEELQDESSPNFVEEVAALFFKDSSRLLTNIEQAIIGALRMKNECSVFKVNCNDRNLEGCRRSLQKMKREHATLKQKLESYFQHCYMAKQLGYLLFLLLMQLLRQVGPRDYAAQETKPNPWAWASLSLRFIYSDARTAYPIPSIPQALTPLSLPWRSSPSTPWPRPRPPSPPPTTTPPSPPTARSPPPPHSPAPALASPPPPPPPSRPRSLQFLKIETKTSQFEPITIPTQITPFGVTSLLRERGQEDQEGKKVQPLVRKCEAAQQEEGNWPCTAVRAACASEEGPVRRRRGHPDRHRR

SEQ ID NO: 19819 - protein, 335 aa, Glycine max
  unsure (1)..(335): unsure at all Xaa locations
VASVCFTEDGFPYGIYNKAVNLTADHNVITRYVYSSFWGFQQISTLASNLTPSYFVWEVIFTLXIIGSGLLLFALLIGNIQNFLQALERRRLEMTLRRRDVEQWMSHRHLAEDLRRKVRQAERYNWAATRGVNEEMLLENLPEDLQRDIRRHLFTFIKKVRIFALLDEPILDAICERLKQKTCTRGSKVLSQGSLVEKMVFVVRGTLESFGDDGTMVPLSEGDACGEELLTWYLEHSSVSTDGKKVRVQGQRLLSNRTVRCLTNVEAFSLRAADLEELTILFTRFLRNPHVQGALRYVSPYWRSLAANRIQVAWRYRKKRLSRANTSQSDQTLIA

SEQ ID NO: 19820 - protein, 548 aa, Magnetospirillum magnetotacticum
MFPPTEGPLLRTFTLTLSGRAVAAVVALVLACAALAATVAYTVADSRASAAAARAEGAAAPVLAAGTAPANPLGITSARYATATATAAAEKPKVVVVATGGTMAGKATGRDTFTSYRAGTYLMEDMLDTLRPELDAVADVTAVQFGNAGSSGYSMEQFHALTLEVEKQLKTADAVVVTTGTDTQEEFAYWLDLTVRSRKPVVTSGSMRPWGSGAGPDSSLVFGTDAPANLYNAIKVAASQQTFCFGTVLMLNDEIQAAREVTKSNSYRTDTFQTREYGVLGWIDGDNVTLGRAPARVLACDTEEWFTPFDLAKVDAKTLPRVEILMSYQQAGGEAVTAFANAGVRGIVTAGTGAGGISSAMSQARTAAVRDKGVWFVSTTRTGSGSSYGGGNGIIAGGDLTAVKARLLLLLSRAFTDDFATAQGWFTTFGNASFDQSATAATVGAEPGSTTVRFSGTATPSCKAAGQQLWLTASVTNEDSVPIDVHVQTPAGEHTFSAVPAGESAEKTLAVKGKTLAAGEITLVATKDVDGRAVQTQTTAAYPETACR

SEQ ID NO: 19821 - protein, 319 aa, Populus euramericana
MEFPVISMEKLNGEERAATMEKIKDACENWGFFELLNHGISHEFLDTVERMTKEHYKKCMEQRFKELVASKALDGVQTEIKDLDWESTFQLRHLPKSNIAEIPDLDDEYRKVMKEFALKLEKLAEELLDLLCENLGLEKGYLKRAFYGSNGSPTFGTKVSNYPPCPKPDLVKGLRAHTDAGGIILLFQDDKVSGLQLLKDGQWIDVPPMRHSIVVNLGDQLEVITNGKYKSVEHRVIAQTDGTRMSVASFYNPGSEAVIYPAPALVEKEAEEKKKVYPKFVFDDYMKLYAGLKFQAKEPRFEAMKAVETTVNLGPIATA

SEQ ID NO: 19822 - protein, 428 aa, Trichodesmium erythraeum IMS101
MKNVLSIILGGGAGTRLYPLTKLRAKPAVPLAGKYRLIDIPISNCINSEIQKIYVLTQFNSASLNRHITRTYNFSGFSDGFVEVLAAQQTKDNPEWFQGTADAVRKYIWLFKEWDIDYYLILSGDHLYRMDYRDFVQRHIDTKADITLSVLPIDEARASEFGVMKIDNSGRIVEFSEKPKGNALKAMAVDTSILGVSPEIATKQPYIASMGIYVFNKDAMIKLIEDSEDTDFGKEILPKSAQSYNLQAYPFQGYWEDIGTIKSFYEANLALTQQPQPPFSFYDEQAPIYTRSRYLPPSKLLDCEITESIVGEGCILKKCRIDHCVLGVRSRIEANCIIQDSLLMGSDFYESPTERRYGLKKGSVPLGIGAETKIRGAIIDKNARIGCNVQIINKDNVEEAQREEEGFIIRSGIVVVLKNATIPDGTVI

SEQ ID NO: 19823 - protein, 415 aa, Polysiphonia forfex
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIASTGEVKGHYMNITAATMEDMYERAEFAKQIGTVIVMIDLVIGYTAIQTMSVWARKNDMILHLHRAGNSTYSRQKIHGMNFRVICKWMRMAGVDHIHAGTVVGKLEGDPLMIKGFYNTLLETYLDINLPQGIFFQQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITF

SEQ ID NO: 19824 - protein, 232 aa, Mycobacterium tuberculosis H37Rv
MRILVVDNYDSFVFNLVQYLGQLGIEAEVWRNDDHRLSDEAAVAGQFDGVLLSPGPGTPERAGASVSIVHACAAAHTPLLGVCLGHQAIGVAFGATVDRAPELLHGKTSSVFHTNVGVLQGLPDPFTATRYHSLTILPKSLPAVLRVTARTSSGVIMAVQHTGLPIHGVQFHPESILTEGGHRILANWLTCCGWTQDDTLVRRLENEVLTAISPHFPTSTASAGEATGRTSA

SEQ ID NO: 19825 - protein, 338 aa, Zea mays
RVDEIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 19826 - protein, 479 aa, Pisum sativum
MEEPTFLFPPPDSDLDLSFTSTTTDRTFTSSSARTSLARTSSLALSFNDRLSTASAAAGDTVSSAIIRRPHRSSDPNWTAIKAATNLSSDGRLHLRHLKLLRHLGSGDLGRVFLCRLRDYDGANFALKVVDKDLLTLKKSTHAETEAEILHALDHPFLPTLYARIDVSHYTCLLIDYCPGGDLHSLLRKQPGNRFTLSAARFFAAEILVALEYLHALGVVYRDLKPENVLIREDGHVMLSDFDLCYKADVSPTFEFSTNHKLHVDPTHGCFSYNRSKSRESVTAEFVAEPTTAFSRSCVGTHEYLAPELVSGNGHGNGVDWWAFGVFIYELLYGTTPFKGCNKESTLRNIASNKDVKFHVAENEEVGMVGARDLIEKLLVKDPRRRLGCARGATDIKRHPFFDGIKWPLIRTYKAPEVKGLLRRKKSESSLSQLSSKRKRGWWKRLGCVLRNKGARFDLLSNYSNNNHYYCYVNNSKVR

SEQ ID NO: 19827 - protein, 372 aa, Zea mays
  unsure (1)..(372): unsure at all Xaa locations
MDAAHWQQGLGLVKPMEEMLMAANAGAANPSQSSNPNPPAPAPSLAPGGLLGGGAPAPLAGAGSTERRARPQKEKALNCPRCXNSTNTKFCYYNNYSLQQPRYFCKTCRRYWTEGGSLRNVPXVGGGSRKNKRSSSSASASASTSGSVTSSSMASTAGAGSKNPKLAHEGAHDLNLAFPHHGGLHAPEFAAFPSLESSNVCNPGGGMTSNGRGGGAGPAVGALSAMELLRSSGCYMPLQMPMPMAMPGDYTAAGFALGEYRTPPPPPSQSVLGFSLDAHGPGSGATAAGYGSSAGLQGVPENAGRLLFPFEDLKPPVGSEGGGGATGGASDGNSSHTQFDHNNKEQGGGGTGAGHDTPGFWSGMIGGSGASW

SEQ ID NO: 19828 - protein, 261 aa, Zea mays
MSLTEAPSPSPSSSSGSDDFAAFLASELELTSGADSAFPGDPSSVFPATDDEGEDEDPEELEVEAIEQNGTKRRRVEEQCQDQGTSVRPDKIPTGASKIVQVEACPHPGHFGGLCIICGKPQDEEDVSGVAFGYIHKGLRLGTSEIDRLRGADLKNLLRERKLVLILDLDHTLINSTKLQDISSAEKDLGIQSAASKDDPNRSIFALDLMPMLTKLRPFVREFLKEASNMFEMYIYTMGDKAYAIEIAKLLDPSNIYFPSK

SEQ ID NO: 19829 - protein, 458 aa, Streptococcus mutans UA159
MENHNFENEGQFKRKMTSRHLFMLSLGGVIGTGLFLSSGYTIAQAGPLGAVISYLVGAIVVYLVMLSLGELAVAMPVTGSFHTYATKFISPGTGFTIAWLYWICWTVALGTEFLGAGMLMGRWVPYVPTWVFAALFALLIFGLNALSVRSFAEAESFFSSIKVLAILVFIILGFGAMLGLVSFNGKHEVFLFSHLTAHGALPKGLPALMSVMLAVNYAFSGTELIGIAAGETNNPKEAVPKAIKTTIGRLVIFFVLTIVVLASFLPMKEAGVSSAPFVDVFDKMGIPFAADIMNFVILTAILSAGNSGLYASSRMLWSLANEGMISPRVVKINEHGVPMRALLLSMAGAVLSLFSSIYAADTVYLALMSIAGFAVVVVWLSIPMAQINFRKEWLKSHAQEDLFYKTPFTPILPYITIMLLLISIIGIAWDASQRAGLYFGIPFILLCYLYYYWRHKTL

SEQ ID NO: 19830 - protein, 370 aa, Corynebacterium efficiens YS-314
MTRTPRTPLATILPDFPWDSLATAKARAGEHPDGIVNLSVGTPVDPVAPGIQIALSEAAGFSGYPQTIGTPELRSAIRAALERRYGMTGLVDASVIPVVGTKEAIALLPFMLGLAGHTVVIPEIAYPTYEVSAVAAGARVLRSDSLLKLGPEVPSMMFLNSPSNPTGKVLGVEHLRKVVGWARDNDVIIAADECYLGLGWDDDNEPLSILDPRVCDGDHTNLLAIHSLSKTSNMASYRAGYIVGDTALVGELTEARKNLGLMVPYAIQQAMIAALNDDEQEAGQKLIYARRRATLMKALLGAGFRIDDSEAGLYLWATRDEPCRDTVDWFAERGILVAPGDFYGPRGTHHVRVAMTETDERINAAAARLA

SEQ ID NO: 19831 - protein, 201 aa, Shigella dysenteriae
MADILLLDNIDSFTYNLADQLRSNGHNVVIYRNHIPAQTLIERLATMSNPVLMLSPGPGVPSEAGCMPELLTRLSGKLPIIGICLGHQAIVEAYGGYVGQAGEILHGKASSIEHDGQAMFAGLTNPLPVARYHSLVGSNIPAGLTINAHFNGMVMAVRHDADRICGFQFHPESILTTQGARLLEQTLAWAQRKLEPTNTLQ

SEQ ID NO: 19832 - protein, 58 aa, Skeletonema costatum
MRGILADWLVEVHLKFKLVPETLYLVVNLIDRYLAKKEVTRSKLQLVGVTALFIATKY

SEQ ID NO: 19833 - protein, 359 aa, Arabidopsis thaliana
MATLVYFQFTFAAITTILVAGSVLGRMNIKAWMAFVPLWLIFSYTVGAYSIWGGGFLYQWGVIDYSGGYVIHLSSGVAGFVAAYWVGPRPKADRERFPPNNVLLMLAGAGLLWMGWSGFNGGAPYAANLTSSIAVLNTNLSAATSLLVWTTLDVIFFGKPSVIGAIQGMVTGLAGVTPGAGLIQTWAAIIIGVVSGTAPWASMMIIHKKSALLQKVDDTLAVFYTHAVAGLLGGIMTGLFAHPDLCVLVLPLPATRGAFYGGNGGKQLLKQLAGAAFIAVWNVVSTTIILLAIRVFIPLRMAEEELGIGDDAAHGEEAYALWGDGEKFDATRHVQQFERDQEAAHPSYVHGARGVTIVL

SEQ ID NO: 19834 - protein, 300 aa, Heterocapsa triquetra
RIGRQVARIAMKDPEVELKLINASYDAEYLAYQMKYDSIHGRYNGTIEVDGDSLVIDGQKVALSHTRDPAEIPFKKHGAEYVCESTGVFLTTEKVQPHLKAGAKKVVFSAPAKDDSHTVVMGVNQETYKSSMECVSCASCTTNGLAPLVKCINDAFGIRRGLMTTIHAMTASQPTVDGASKKDWRGGRAASGNIIPSSTGAAKAVAKVIPEVAGKLTGMAFRVPTIDVSVVDLTCELEKATTYEEICAEVKKRAEGDMKGFLGYCDEDLVSTDFETCTISSTFDSKAGIMLDPTFVKLVA

SEQ ID NO: 19835 - protein, 359 aa, Capsicum chinense
MGSINQSLTQTEDEAFVFAMQLASASVLPMVLKATVELDLLEIMAKSGPGAFISPSELAAQLPTKNPEAPVMLDRMFRLLATYSVLNCTLRTLPDGRVERLYSLAPVCKFLTKNGDGVSIAPILLMNQDKVLMESWYHLTDAVLDGGVPFNKAYGMTTFEYHGTDPRFNKVFNCGMSDHTTLSMKKILEDYTGFEGLNSIVDVGGGTGATVNMIVSKYPSIKGINFDLPHVIRDAPSYPGVEQVGGDMFVSVPKADAIFMKWICHDWSDDHCIKLLKNCYEALPANGKVIIVECILPEAPDTSAATKSKVHGDIIMLAHNPGGKERTEKDFEALANWGWFSRFRKVCCAYHTWVMEFNK

SEQ ID NO: 19836 - protein, 497 aa, Zea mays
  unsure (1)..(497): unsure at all Xaa locations
FCFALQFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPSDYRHMEGFGVNTYTFVSAAGKAQYVKFHWKPTCGVRCILTDEEAALVGGRNHSHATQDLYDSIAAGSFPEWTLYVQVMEPDTEEQYDFDPLDDTKTWPEDLLPLRPVXRLVLDRNVDNFFNENEQLAFGPGXLVVPGIYYSDDKMLQCRVFAYADTQRYRLGPNYLMLPVNAPRCAHHNNHYDGAMNFMHRDEEVDYYPSRHAPLRQAAPPTPLPPRPVAGRREKATIRKPNDFKQPGXERYRSWDADRQDRFVKRFADSLGHPKVSQELRSIWIDLLAKCDASLGMKIATRLNMKPNM

SEQ ID NO: 19837 - protein, 487 aa, Pseudomonas putida
MRETKEQPIWYGKVFSSNWVEARGGVANVVDPSNGDILGITGVANGEDVDAAVNAAKRAQKEWAAIPFSERAAIVRKAAEKLKEREHEFADWNVRECGAIRPKGLWEAGIAYEQMHQAAGLAYLSNGTLFPSAVPGRMNLCQRVPVGVVGVIAPWNFPLFLAMRSVAPALALGNAVILKPDLQTAVTGGALIAEIFSDAGMPDGVLHVLPGGADVGESMVANSGINMISFTGSTQVGRLIGEKCGRMLKKVALELGGNNVHIVLPDADLDGAVSCAAWGTFLHQGQVCMAAGRHLVHRDVAQQYAEKLALRAKNLVVGDPNSDRVHLGPLINDKQVVRVHALVESAQSAGAKVLAGGTYQDRYYQATVIMDVKPEMEVFKSEIFGPVAPITVFDSIEEAIELANCSEYGLAASIHTRALATGLDIAKRLNTGMVHINDQPINCEPHVPFGGMGASGSGGRFGGPASIEEFTQSQWISMVEKPANYPF

SEQ ID NO: 19838 - protein, 439 aa, Thermus aquaticus
MKGAEALLKALEREGVEVIFGHPGGAIMPTYDALYDSPIRHILVRHEQGGIHAATAYARASGRVGVVMATSGPGALNLVTGLADALMDSTPVVAITGNVPRALIGTDAFQEADVTGVTMPITNHNYLVQDVNEIPRVVKEAFHIASTGRPGPVLIDLPKDVQLAEFTGEFDVELDLPGYKPTLRGHPKQIERALDALEKAERPILMVGGGAQHAHAELLAFAEKTGLPVITTLMGLGAFPGNHPLWLGMPGMHGTVAANRAIHHADVILAIGSFDDRVTGKVSRFAPTPTPSSTWTLTRRRSARWVRTHIPIVGDSRLVLKEMLKGAKPLRLAAWWRELEECAPATPSAIGPGPPQARRSSAPSTEATGGNAIVTTGVGQHQMFAAQYFTVTRPRSFLTSGGLGTMGVGLPFAIGAQIARPEELVIDFDGDGSFQMTLQ

SEQ ID NO: 19839 - protein, 435 aa, Spyridia filamentosa
  unsure (1)..(435): unsure at all Xaa locations
ETDVLALFRVTPQPGVDPVEASAAVAGESSTATWTVVWTDLLTACDLYRAKAYKVDEVPNSTEQYFAYIAYDIDLFEEGSIANLTASIIGNVFGFKAVKALRLEDMRIPYAYLKTFQGPATGLVVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKDLGTVIIMIDLVIGYTAIQTMGIWARKNDMILHLHRAGNSTYSRQKNHGMNFRVICKWMRMAGVDHIHXGTVVGKLEGDPKMIQGFYRTLLEPFLEVDLPQGLFFEQDWASLRKVTPVASGGIHCGQMHQLIQYLGNDVVLQXGGGTIGHPDGIQAGAXANRVALESMIIARNEGRDYISEGPQILRDAAKTCGPLQTALDLWKDITFN

SEQ ID NO: 19840 - protein, 130 aa, Glycine max
  unsure (1)..(130): unsure at all Xaa locations
IADADATIDYRAGALVHTSFTGLKAMAGFPTMRTNNDITSIASNRGRVQCMQDWPPFGKKMSVTLSYLPDLDDAQLAKEVQYLLMNGWILWLXEFGAEHGFXYRERNRSPGIYHGRYWTMCTLTMTGCTD

SEQ ID NO: 19841 - protein, 701 aa, Zea mays
  unsure (1)..(701): unsure at all Xaa locations
DGAPWSEIDLEFLVQAPTNSFGARLDVIVYTLLSGGEPSKLKEXNPYKKGDRGRYIGPIQSSGFMFEGQRAPDYGSQGEVRLTFAENGSSKVGVRFDKQIPGGIDLGGSCELDHGLFCSVDSLCLDGPGWEDRAKHSFDVVFEFASEESQQVPVILFLKDVEKICGNNYTYHGLKNKLESFPAGVFIVGSQIQTDARKDKSNNGSPWLKFSYSQAAILDLAFQDSFGRVGEKNKEALKMSKHITKLFPNKVTIESPEDETELSQWKQLLGRDIEILKAKANFLKIQSFLTRHGMECTDLESVVCVKDRNLTSECVDKIVGYALSYQLKDHPIQTPGKDARVVLSGVSLKYGIDLLESIQSGPKKKSTKKSLKDVVTENEFEKRLLPDVIPPDEIGVTFEDIGALENVKETLQELVMLPLQRPELFSKGQLMKPCKGILLFGPPGTGKTMLAKAVATEAGANFINISMSSIASKWFGEGEKYVKAVFSLASKISPSVIFVDEVDGMLGRRENPGEHEAMRKMKNEFMVNWDGLRTKDKERVLVLAATNRPFDLDEAVVRRLPRRLMVNLPDAPNRKKILSVILAKEDLADDVDLEALANLTDGYSGSDLKNLCITAAHRPIREILEREKKERTLAEAENRPAPPQCCSGDVRSLKFSDFKHAHEQVCASISSDSKNMNELVQWNDLYGEGGSRHKTPLSYFM

SEQ ID NO: 19842 - protein, 553 aa, Thermobifida fusca
MGSPSFSGKLTGHGGNHAVEVARHHGVDTLFTLSGGHIFPIYDGAVKADPPMRLLDVRHEQTAVFAAEAVGKLTRRAGWAALTAGPGVTNGVSGIATAHFNGSPLVVVGGRAPDNRWGQGLLQELDQSPLFTTITKRAWTVHDTAQIGPALDEAFTLANTAHRGPVFLDIPMDRLYDQAEITVTGQAAAEDRSPDPDAVAAVARLLSEAERPVLVYGSDVWLDHAEQAALEAAEELGVPVVTNGQGRGVLPAGHPLLATRARGLALGRADLVIVVGTPLDFRLNHGLFGGRDGAPLARTVHITDSPAQLATHLTLAGAVSGDLSAILRALAEQAKPKREVAQWRTEVAEAAAATAAKDREVLDSDASPIHPARIYGELNRILDDDAVVIGDGGDFVSYAGKYIQPRRPGNWLDPGPFGCLGTGMGYAIAARLVRPSSQVVALFGDGALGFSLADVDTLVRHNLPVVMVCGNNGIWGLEKAPMQLVYGYDVLADLAPQTRYDQVVTALGGGGELVTDPAEIGPALRRAFDSGVPYLVNIVTDPENVYPRKTMGV

SEQ ID NO: 19843 - protein, 229 aa, Thermus thermophilus
MKIRDLLKARRGPLFSFEFFPPKDPEGEEALFRTLEELKAFRPAFVSITYGAMGSTRERSVAWAQRIQSLGLNPLAHLTVAGQSRKEVAEVLHRFVESGVENLLALRGDPPRGERVFRPHPEGFRYAAELVALIRERYGDRVSVGGAAYPEGHPESESLEADLRHFKAKVEAGLDFAITQLFFNNAHYFGFLERARRAGIGIPILPGIMPVTSYRQSAASPRSAGRASP

SEQ ID NO: 19844 - protein, 132 aa, Nostoc sp. PCC 7120
MPITHQNLIEMMTYALVLSGNRVITSGATGTNSAAIKGAMRADPNLLTVILPQSLERQPQESRQQLEQVMHLVENPSNDNLSLAEASYLCNKEIVSRCQQLICFAFHDSRTLLQTCGDAEEQRKVVTLFYFD

SEQ ID NO: 19845 - protein, 769 aa, Arabidopsis thaliana
MWRLRTGPKAGEDTHLFTTNNYAGRQIWEFDANAGSPQEIAEVEDARHKFSDNTSRFKTTADLLWRMQFLREKKFEQKIPRVIIEDARKIKYEDAKTALKRGLLYFTALQADDGHWPAENSGPNFYTPPFLICLYITGHLEKIFTPEHVKELLRHIYNMQNEDGGWGLHVESHSVMFCTVINYVCLRIVGEEVGHDDQRNGCAKAHKWIMDHGGATYTPLIGKALLSVLGVYDWSGCNPIPPEFWLLPSSFPVNGGTLWIYLRDTFMGLSYLYGKKFVAPPTPLILQLREELYPEPYAKINWTQTRNRCGKEDLYYPRSFLQDLFWKSVHMFSESILDRWPLNKLIRQRALQSTMALIHYHDESTRYITGGCLPKVVVAFHMLACWIEDPKSDYFKKHLARVREYIWIGEDGLKIQSFGSQLWDTALSLHALLDGIDDHDVDDEIKTTLVKGYDYLKKSQITENPRGDHFKMFRHKTKGGWTFSDQDQGWPVSDCTAESLECCLFFESMPSELIGKKMDVEKLYDAVDYLLYLQSDNGGIAAWQPVEGKAWLEWLSPVEFLEDTIVEYEYVECTGSAIAALTQFNKQFPGYKNVEVKRFITKAAKYIEDMQTVDGSWYGNWGVCFIYGTFFAVRGLVAAGKTYSNCEAIRKAVRFLLDTQNPEGGWGESFLSCPSKKYTPLKGNSTNVVQTAQALMVLIMGDQMERDPLPVHRAAQVLINSQLDNGDFPQQEIMGTFMRTVMLHFPTYRNTFSLWALTHYTHALRRLLP

SEQ ID NO: 19846 - protein, 279 aa, Zea mays
MTMAGSCAAVPVAGLPSLRTPMPTHLRLGGFMPCSSAARSRGAAVLGCALGARKQTPGVLNQLLCRYMRRDGHEGDVSNQGRDGAVMFGPDDDGVKIPTQVETLVKGTAAVAEPEYKQIPDVDYLQELLAIQQQGPRAIGFFGTRNMGFMHQQLIEILSYAMVITKNHIFTSGASGTNAAVIRGALRAEKPELLTVILPQSLKKQPPESQELLSKVQNLLEKPQYDHLPLIEASRLCNMDIISKVQQVICFAFHDSKLLMETCQEAMNLRKIVTLFYLD

SEQ ID NO: 19847 - protein, 1209 aa, Trichodesmium erythraeum IMS101
MGRKCILGFILFLLTLTLTILHGSVISKNTNDYQLSNQIKEVKTWQTSELEKEQYNFYQSSEEDFIKPQKFDHLQTVINKKDLPVYKNLSTSKPHSTYKVTDILWLLISSGLVFLMQPGFMCLESGLTRSKNNINVAFKNLTDFGISVFCFWSIGFAFMFGTSASGIIGHSNFFFATNVQPLDAAFFLFQVMFCGTATTIVSGAVAERMKFGTYLFVAFLVSGFIYPIFGHWAWNGIDTGVLRGWLGQRGFIDFAGSTVVHSIGGWVSLATLLVIGPRTGRFPRDRPPEKIHGSNLPLSILGVMLIWFGWFGFNGGSTLALNEQVPGIIVNTIFSSVAGMITGLSIGWSIRGIPGVDLIINGTLGGLVAITASCHAVTTLSAVIIGFIGGIVTILVEQILEKIRVDDAVGAIPVHLGAGIWGTLAVALFGKPEILGTGLSLSEQLTVQLLGVCTAFLLGFFVVYPILLITNKFFLLRVSTEDEHIGLNISEHHAKTEILDLFEIMSSQASTQDLTLRVPVEPFTLVGQIAERYNHVMDTLEEVTTRNDAIIKLATDAIITFNKSELEIISVNPSAEKIFSYKPQDLVGMPIYEILDFTINPLMREKIDSNDLITEGKKSTVEALKLWVNPSFISFPTREIINAYYTFNFQDIKPENLQSYFPNFIHLFDKNSADTQIELETEKKITQKKYYIERLISLIAETGNLYELVGIRKDGSLFPIEIAVREAKLNQKNFYTGTFRDISERKESEAKLKENEQRFRSLSTATFEGIIIYEQGKIVDANTAALQMFKYELSEIIGMNGLELIDSKYKNLVWKNMSSGYEKPYEVVGIRKDNSTFPIEIQAKTFFYCSYQHRVSAIRDITERKLAEKALRESEEKFRAVMEQAADAFIIHDLQGKIVDVNQSTCQTLGYTYEELLHLFIEDIEINFVLEYLYQKWQKLIPGIPITLQGTHKRKDGTTFPVEVRLGLLKAGNGNLVLALCRDITERKKVEQALLLEQGKSEKLLLNILPKPIADKLKENQDIIAEGFDEVTVLFADLVGFTQLASSVYPKRLVYWLNEIFSKFDLLAEKYGLEKIKTIGDAYMVVGGLPTPMENHAEAIALIAIDMREELAHFAHKSKQDFLIRIGINTGPVVAGVIGRKKFIYDLWGDTVNIASRMESQGIPGVIQVTEATYQILKHKFLFTERGLIHIKGKGYMKTYFLQGKKVIP

SEQ ID NO: 19848 - protein, 854 aa, ASPERGILLUS NIDULANS FGSC A4
MPERTLLNFLVARQDLLDPSNDPNVGSSRGNASSTTSETLDTITGGGDSTSLSSLISTLLPALLLAIIWFSIFLIFRRTQVRCEKSPQLPTGWVNWVGQFLKISDAHVLNHHSMDGYLFLRFLRILCVTFFVGCLITWPILLPIHATGGVGNTQLDALSFSNVKDKSRYYAHAIMACVYFAYVFYNVTRESIFYANLRQAYLNSPAYAHRISSRTILFMSVPEDYKNEKKLQQVFGNTIRRIWITSDCKELEKKVQERDKYAHRLERLETRLIRSANTVHMKLLKAGTIPSTECADCEAIDSTMYHKIRRPAHRTKLFGEKVDSIRWLREKIVSLSKEIEVLQKKHQNHEGRLLSAIFIEFNSQSDAQIALQTLSHHQPLHMTPRFSGISPDEVVWSALNLSWWQRIVRRFLVQGGIAAMIIFWSIPSALVGTISNISYLTSEIPFLRFIDDLPEVIKGVIAGLLPAAALVLLMSLVPIICRYSARRAGVPSASRVELFTQSAHFCFQVVQVFLVTTLTSAASAATAQIIQDPLSAKDLLAENLPKATNFYISYFLLQGLTISSMAVVQIMSVLVFKFITTFFDGSPRRLYERWAALSGISWGNVFPVFTNMGVIALTYSCIAPLILGFCFVGVYLVYQAYRYNFLFVYDIRIDTKGLVYPRALQHLLTGVYLANICLIGLFAIKSAIGPLLIMVFFTILFICAHLSLNEALGPLYSFLPRTLDVEEELQQAKEEELALLQTMPRSRWTRTLKWFHPNLYRDFAALRRKVRRDHVEIRYSDEERRNAYFEPCITAKTPTIWIPRDKWGVSKVEIEESDPSIPITDNGAHLDERGKIVWDKFDPNLPLWELKTLY

SEQ ID NO: 19849 - protein, 152 aa, Neisseria gonorrhoeae
  unsure (1)..(152): unsure at all Xaa locations
GSHMAATYKKPSDAELKRTLTEEQYQVTQNSATEYAFSHEYDHLFKPGIYVDVVSGEPLFSSADKYDSGCGWPSFTRPIDAKSVTEHDDFSFNXRRTEVRSRAADSHLGHVFPDGPRDKGGLRYCINGASLKFIPLEQXDAAGYGALKGEVK

SEQ ID NO: 19850 - protein, 404 aa, Glycine max
SIFANFLYRSWLIDIGGFAKKVKSTTLSSADQIKDCGAYRECPNCSYHIDNSDVSTEWPGFPLGVKFDPSDVELLEHLAAKCGIGNTQQHMFINEFIPTLEGDQGICYTHPENLPGAKKDGSYVHFFHRTTNAYATGQRKRRKIHHQQGLTEEHVRWHKTGKTKAIIEDGAHKGFKKIMVLYVRSSENGSRSYKSNWVMHQYHLGTVEEEKEGEYVVSKIFCQQQKQTEKNEGNPMAEDPDNIISRTGPRTPKPNPPNPPRAGKSVDCDDNIDETVLLSSALDTKTIPGESHAPQSDIQDQDFTGNAAWLAGESQAEESTKYDGCDDILLCKEILDSSAILNDPGLDSTNLEDIAGYATQRARNDNESCGISVLDSLELDTPDFDLSSLYFCSQDSILDWMDRL

SEQ ID NO: 19851 - protein, 178 aa, Triticum aestivum
  unsure (1)..(178): unsure at all Xaa locations
MAPTVMASSATVVSPFXGLNSTSFLPFSLLSNGSSLCSVSNGGRIMCMHVWPIEGIKKFETLSYLPPLSTDALLKHVDYLIRSKWVPCLEFNKVGFIFREHNPSPWFYYGRYWTMWKLPMFXGCTDATQVINEVEEVKKEYPDAYVPHXSGFDNMRQVQCVSFIAFKPPGCXEESGKA

SEQ ID NO: 19852 - protein, 276 aa, Bacillus sp.
MKKKLVLFSMCLLLFSGLISGLVQSPQVAEAAERPIGTAFVETFESYDSERWSKAGVWSNGQMFNATWYPEQVTFSNGKMKLQIEKEDNETASPPYKAGELRTNDFYHYGLFEVSMKPAKSTGTVSSFFTYTGPWDWENDPWDEIDIEFLGKDTTKIQFNYFTNGVGGNEHYHELGFDAADDFNTYAFEWRPESIRWFVNGELVHTATENIPQTPQKIMMNLWPGIGVDGWTGRFNGEDTPVVTQYDWVKYTPLEELGCYNEKNNKYKKCKKTKVK

SEQ ID NO: 19853 - protein, 666 aa, Desulfovibrio desulfuricans G20
MSSFKRNVYLKTVPIPQAVETVRGALDRESLVRTQRVASHEAAGRVTAEAVYARFSSPTFHSAAMDGFAVRADDTFAAREDAAVTLQVQTARTGGPLQAGHAVAVNTGHPLPEGADAVIMIENVVAALPDSTAPQSISIEAPAFPWQHVRRIGEDIVATELLFPQGHTLTAYDVGTLLSGGIWEVRVYERIRVRIIPTGDEVLDFTARPEPGPGQVIESNSQVLATLARGLGCEVERVAPVPDVPEVIRQAVTASLDDNVHLTVICAGSSAGSKDYTRATIAALGEVLVHGIAAMPGKPSLLGLCKGRLVAGAPGYPVSSVICFEELLAPLIAWLGRGEAPRRESVTVEMTRKVPSKLGVEEFLRLSVGRVGYKYMATPLGRGAGCITTLSRAQAVTRIPANAEGLEQGQSVPAELMVSRTALERTLVCVGSHDNTLDALADELMGLDTPCRLASSHVGSMGGIMAVKNGSCHMAGVHLFDPDSGDYNMPFIRKYLPETPAVLINLAIRHQGFIVPAGNPHNIRGIEDVARQGLRFINRQRGAGTRILFDWHLKQCGLQSDAIRGYGKEEYTHMAVAANVLTGSADCGLGIRAAAKALGLDFVPLARERYDLLIPEQFMEDPRVMAVMQLLGSPAFLARIEALGGYETTLTGQVMQAGTALGEHGR

SEQ ID NO: 19854 - protein, 337 aa, Desulfovibrio vulgaris subsp. vulgaris (strain Hildenborough)
MPEVTVTEHLLLHQKKSPAATGQFTTLLNDLVLSAKIISRSVTKAGLLDVLGGTGEVNVQGELVQKLDEFANRVLIYRMERSGAVCAMASEENADIIKVPEKLHRGDYVLIFDPLDGSSNIDVNINVGTIFSILRRKSPASDDVCIDDVLQPGYEQVAAGYILYGPSTMLVFSTGQGVHGFTLDPSVGEFLLSHPDMSIPERGRIYSINESYWNYWDEPTREIVSYFKGDHNERGKPYSLRYVGSLVADFHRTLLYGGIFMYPMDYRHPDKPQGKLRLMCEASPLAFLAEQAGGRAIDGSRRILDVCPGTLHERIPLFIGSARDVDKVEEIYARHRA

SEQ ID NO: 19855 - protein, 389 aa, Arabidopsis thaliana
MALSRLSSRSNIITRPFSAAFSRLISTDTTPITIETSLPFTAHLCDPPSRSVESSSQELLDFFRTMALMRRMEIAADSLYKANVIRGFCHLYDGQEAVAIGMEAAITKKDAIITAYRDHCIFLGRGGSLHEVFSELMGRQAGCSKGKGGSMHFYKKESSFYGGHGIVGAQVPLGCGIAFAQKYNKEEAVTFALYGDGAANQGQLFEALNISALWDLPAILVCENNHYGMGTAEWRAAKSPSYYKRGDYVPGLKVDGMDAFAVKQACKFAKQHALEKGPIILEMDTYRYHGHSMSDPGSTYRTRDEISGVRQERDPIERIKKLVLSHDLATEKELKDMEKEIRKEVDDAIAKAKDCPMPEPSELFTNVYVKGFGTESFGPDRKEVKASLP

SEQ ID NO: 19856 - protein, 434 aa, Glycine max
PRRPSVRLFACTASDHVNLTRPEPYGAGVGGLSRDIPETANVKLPCNTTHCQNSSKSKQARPITVGIVLLTIAVSAIGILTFTVYRRRKQKLGSTFDISEGCLSTDEAIGAYRKNGSPLVSLEYSTGWDPLADSRNFNGYRQEMFQSFRFNLEEVESATQYFSELNLLGKSNFSATYKGVLRDGSVVAVKSISKTSCKSDEAEFMKGLNMLTSLRNENLVRLRGFCCSRGRGECFLVYDFVSNGNLSRYLDVKEGDGEVLEWSTRVSIVKGIAKGIAYLHAYKAKKPALVHQNISAEKVLIDQRYNPLLSDSGLYKLLTNDIVFSALKGSAAKGYLAPEYTTTGRFTEKSDVYAFGVLLFQILTGKQKITSAMRLAAESFKFPEFIDPNLRGKFFEYEAAKLARMALLCSHESPFERPSMEAIVQELGNCSSCL

SEQ ID NO: 19857 - protein, 197 aa, Desulfitobacterium hafniense
MLAIIDNYDSFTYNLVQAFGELGEKVTVCKNDEVSGAEFLSENPDGVVISPGPCTPNEAGISLEVIRLLNERAQEGRPTPLLGVCLGHQALAQAFNSEIILAPEIVHGKQSLIYHDETELFAECTQGFLAGRYHSLMVDPLGLSPLFIVTARTENNLIMGIRHRYFPFYGVQFHPESILTPEGPQILRSFLTQVHHQ

SEQ ID NO: 19858 - protein, 203 aa, Oryza sativa (japonica cultivar-group); identical to SEQ ID NO: 615

SEQ ID NO: 19859 - protein, 482 aa, Pseudomonas aeruginosa PAO1
MEEKTRLTTAAGAPVVDNQNVQTAGPRGPMLLQDVWFLEKLAHFDREVIPERRMHAKGSAAYGTFTVTHDITPYTRAKIFSQVGKKTDMFLRFSTVAGERGAADAERDIRGFSMRFYTEQGNWDLVGNNTPVFYLRDPLKFPDLNHVVKRDPRTNLRNATFKWDFFSHLPESLHQLTIDFSDRGLPKSYRHIHGFGSHTFSFINANNERFWVKFHFKTQQGIENLTNAEAAEVIAQDRESSQRDLYESIEKGDFPRWKMYVQIMPEKEAATYRYNPFDLTKVWPHGDYPLIEVGFFELNRNPDNYFAEVEQAAFTPANVVPGIGFSPDKMLQGRLFSYGDAHRYRLGVNHHQIPVNAARCPHQVYHRDGGMRVDGNNAHQRVTYEPNSFNQWQEQPDFSEPPLSLEGAADHWNHRVDDDYYSQPAALFHLFTDEQKQRLFANIAEDIRDVPEQIQRRQIGLFLKVDPAYGKGVADALGLKLD

SEQ ID NO: 19860 - protein, 528 aa, Medicago truncatula
MGLEVLEALDSARTQWYHVTAIVIAGMGFFTDAYDLFCISTVSKLLGRLYYFDPSTNKPGKLPPSVNNVVTGVALVGTLSGQLVFGWLGDKLGRKKVYGVTLIIMVACAICSGLSFGSSAKSVMITLCFFRFWLGFGIGGDYPLSATIMSEYANKRTRGAFIAAVFAMQGVGIIFAGLVSMVFSGIFKAYYQAPRFNEDPILSTQPEGDLLWRLILMIGAVPAAMTYYWRMKMPETGRYTAIVEGNAKQAAADMARVLDIEIIAEQDKLAEFKAANDYPLWSSEFFNRHGRHLIGTMSCWFLLDIAFYSQNLTQKDIYPAMGLIRQDKEMNAIDEVFQTSRAMFVVALFGTFPGYWFTVFFIEKLGRFKIQLVGFFMMSFFMFVIGVKYEYLKDENKNLFALLYGLTFFFANFGPNSTTFVLPAELFPTRVRSTCHAFSAASGKAGAMVGAFGIQYYTLDGTPRKIRRAMMILAFTNLIGFFCTFLVTETKGRSLEEISGEDGRESELTATPNDRAPGIRQDSRTEKM

SEQ ID NO: 19861 - protein, 204 aa, Oryza sativa
  unsure (1)..(204): unsure at all Xaa locations
FKSGQTKMKSVLVDFLVGAGIKPTSIASYNHLGNNDGMNXSAPQTFRSKEISKSGVVDDMVSSNAILYEPGEHPDHVIVIKYIPYVGDSKRAMDEYTSEIFMGGKNTIVLHNTCEDSLLAAPIILDLVLLAELSTRIQLKAEDQDKYHSFHPVATILSYLSKAPLVPPGTPVVNALAKQRAMLENILRACVGLAPENNMMLEYK

SEQ ID NO: 19862 - protein, 399 aa, Geobacter metallireducens
MKETFDHGGTVFAVARQLGVSPDEILDFSASINPLGPPVEARGAVAAAFDRLVHYPDSGATELRDALARRHHLLPENICVANGSTELIYLVPRLVGGRRGLIVAPPFSEYAKGLSRAGWEIDYLDLSPADCFTLHLEALDQRLAKGCDLLFLANPGNPTGALIPREVIVEVVSLCRRHGTFLVLDEAFIDFCEEESATDLVVAGEGAVVLRSMTKFYAIPGLRLGYAMGSEEVIARLSALREPWSVNTLAQAAGLACLADGEYPARTRALVETEREWLSAGIARLPGLAVYPSAANYLLVRIDAGPTAPELATRLLAERVLIRDCSSFRGLSERFFRVAVRGTEENRRLLELLGRVFAVDITRKHRATVFSVNKLVQKWSEFRVIPLLVVFHHGIEDGE

SEQ ID NO: 19863 - protein, 412 aa, Glycine max
MELFATTMVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 19864 - protein, 471 aa, Bacillus cereus ATCC 14579
MGEDKKLGLFTLTALVVGSMIGGGAFNLASDMAKGAGAGAIIIGWVITGIGMIALGLSFQNLTVKRPDLDGGIFSYAKAGFGNFMGFNSAWGYWLSAWLGNVAYGTLLFSSLGYFFPIFEGGQNVESIIGASVLLWCVHMLILRGVQSAALVNLVTTIAKLVPVFVFIVIGIFAFHIDTFLDGFWGQTGSFSWGAVGSQVKSTMLVTLWVFIGVEGAVVLSSRAKNRSDVGKATVIGLIGTLIIYILITLLSLGLMQQADIAGLKNPAMAYLFESVVGKWGAIFINLGLVISVLGAWLGWTLLASEIPYLAAKDGVFPKWFAKENKNKAPVNSLWITNGLIQIFLLTFVVSDQAYNFAFSLASSAILIPYAFSAFYQLKHSLKSEEADRNKNIIIGLIASIYGVWLVYAAGLEYLLLTMTLYAPGIFIFYNVQKQKSSKQIFTRVELASSVAIGALAFFAIYGLITGSITL

SEQ ID NO: 19865 - protein, 311 aa, Vibrio cholerae
MKVAVIGAAGGIGQALALLLKNRLPAGSDLALYDIAPVTPGVAADLSHIPTPVTIKGYAGEDTTPALEGADVVLVSAGVARKPGMDRADLFNVNAGIVKALAEKIAVVCPKACVGIITNPVNTTVPIAAEVLKKAGVYDKRKLFGVTTLDVIRSETFVAALKDKDPGQVRVPVIGGHSGVTILPLLSQVEGVSFTDEEVAALTKRIQNAGTEVVEAKAGGGSATLSMGQAACRFGLALVKALQGESDVVEYAYVEGEGEYAPFFAQPIKLGKNGVEELLDIGKLSAYEQAALDGMLDTLKGDIQIGVEFVK

SEQ ID NO: 19866 - protein, 211 aa, Zea mays; identical to SEQ ID NO: 11095

SEQ ID NO: 19867 - protein, 341 aa, Clostridium perfringens str. 13
MDKKTAIDWNNLGFSYMKTDYRYISHYKDGKWDEGKLVTDNKLSISEASTALHYGQQCFEGLKAYRTKDGKIQLFRVDENAKRMNKSCDKLLMPEIPVEKFIDACMQVVKANERFVPPYGTGATLYIRPFMIGVGDNIGVKSAPEFIFSVFCLPVGAYFKGGMKPVNFMIADYDRAAPKGTGAAKVGGNYAASLKAHEIAAKKGFADCIYLDPATHTKIEEVGAANFFGITKKGEFVTPYSESILPSITKYSLMQIAKDYLKMPVSERDVLIDNLDEFAEAGACGTAAVITPIGGIEYKNKLHVFHSETEVGPITKKLYDLLSGMQFGDVEAPEGWIFEVK

SEQ ID NO: 19868 - protein, 468 aa, Saccorhiza polyschides
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVAALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPEILRNAASTCGPLKAALDLWKDITFEYTSTDTPDFVEVATESN

SEQ ID NO: 19869 - protein, 476 aa, Myriogramme livida
NDRYESGVIPYAKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKALGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 19870 - protein, 320 aa, Streptococcus agalactiae NEM316
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGARLQESGVMFVKELNAPKARLKLLIALNAGLTGQNLKDYIEG

SEQ ID NO: 19871 - protein, 453 aa, Sargassum obtusifolium
  unsure (1)..(453): unsure at all Xaa locations
KXTDILALFRITPQPGVDPVEAADVVGGESSTATWTVVWTDLLTACDIYRAKAYRVDPVPGTNDQYFSYIAYECDLFEEGSLADLTASIIGNVFVXKAXXALRLENMXIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATIENMYERAEYSHAIGSVICMIDLVVGYTAIQTMAIWARKAEMILHLHRAGNSTYARQKNHGINFRVICKWMRMSGVDHIHAGTVVGKLEGDPLMVRGFYNTLLLTELKINLAEGLFFDMDWASLRKCVPVASGGIHCGQMHQLLYYLRDDVVLQFGGGTIGHPDGIQAGATANRVALEAMVLARNEGRDYVGEGPEILRTAASTCGPLKAALDLWKDITFXXXSTDTPDFVEVATESP

SEQ ID NO: 19872 - protein, 349 aa, Zea mays
MRQISSLLQGLARSLSVGRDRKGNGAGDGKTAVPVPAVLRTSGTLWGDGSDTFAAVCSRRGEKGINQDCSIVWEGFGCQEGTIFCGIFDGHGPWGHYVAKAVRDSLPPSLLCHWQEALALASLIDDGEKKLGDCQFDLWKRSYVAACAAVDDELRRSRRLDAVQSGCTALSIVKQGDLMIVANVGDSRAVLGTTSGDGAIAAVQLTVDLKPNLPQEKERIRRCNGQVYCLADEPGVHRVWQPSRESPGLAMSRAFGDYCVKDCGVISTPEVTQKRISSSDQFIILATDGVWDVLSNDEAVHIVAGTPDRAKAAKRLVECAVRAWRRKRRDIAVDDCSAICLFFHPPPPS

SEQ ID NO: 19873 - protein, 213 aa, Oceanobacillus iheyensis HTE831
MKFFIDTANIDDIRAANSLGILAGVTTNPSLVAKEGVSFHDRLREITKEVSGSVSAEVISEDAEGMIEEGKELAAIAPNITVKVPMTLEGLKAVKVFSELNIKTNVTLIFNANQALLAARAGATYVSPFLGRLDDIGQDGMTLISAIAEIFDRHSVSTEIIAASIRHPLHVTDAALNGAHIATIPYKVLEQLVKHPLTDQGIQKFLDDWNSQK

SEQ ID NO: 19874 - protein, 554 aa, Oryza sativa
  unsure (1)..(554): unsure at all Xaa locations
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRXAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 19875 - protein, 188 aa, Zea mays
  unsure (1)..(188): unsure at all Xaa locations
MASSMLSSAAVVTSPAQATMVAPFTGLKSSAAFPVTRKANNDITSIASNGGRVSCMKVWPPVGKKKFETLSYLPDLTEVELXKEVDYLLRNKWIPCVEFELEQXDFVYREHGSTPGYXIDGRYWTMWKLPLXFGCTDSAPRGLKEVQEXKTEYPNAFIRDSSIEQTGPGSKGASFSSPTNHKGFPGGV

SEQ ID NO: 19876 - protein, 115 aa, Triticum aestivum
  unsure (1)..(115): unsure at all Xaa locations
MAAQXGXMRLVSHPIXAHDGRLPRQYXXDGQGAKKDMSPPLEWYXLPDGARSLALXVQDIDPTQLXXTHXVVXNIPPATKGSXRGLXRRGGLQLRRQEGSTGHRLGPPHDHLPYK

SEQ ID NO: 19877 - protein, 411 aa, Methanosarcina acetivorans C2A
MMMEMLLLFFYIIGFTCFSVGILTITYFPLSLAFEMRKSKQHIFNSDNPFISIVVPAYNEEKVIAHCIDSILASDYSEYEVILVDDGSSDNTLEEMQRYETNSRVIVVTKKNGGKASALNMGLNLAKGEVIFFVDADGIFAPDTISKMLGGFSSEDVGAVCGSDAPVNLDKLQTLLANLLTHVGTGFVRRALDTIDCLPVVSGNIGAFRRITLEKTGPFLEGFIGEDIELTWRVHKAGYKVAFQPWAIVYVEVPSTIKGLWKQRVRWARGLLKTAYIHRDMLFNPRYGLFALYLPINLASMIIIPLLQLISIILLPILLFLNINPIPLGWMSIIGWLGLIFAFIASLFAIALDRAWIDLKYFYVIPLWVPYSLMMDAVMLWAIIVELRREEAKWNKLDRTGIVSRGEIPKQ

SEQ ID NO: 19878 - protein, 352 aa, Triticum aestivum
LSLDLVREWMEEHAGPAMTPARGDEERDLTISGLATYQPYDGILALKMALAGFMRQIMHESVSFDPSQMVITSGATPAMEILSSCIADPGNAFLVPSPYYPGWDRDIKWRTGIELIPVPCRSTDNFNISITALEIAYNQAKKRGVRVRGVLISNPSNPTGSFVPKQTLRDLLDFATEKNIHLISDEVFAGSTFGSGEFVSVAEVVNELEDFDRGRVHIIYGLSKDLSLAGFRVGVIYSYNESIVEAAAKIARFSSVSTPTQRLLVAMLSDQKFISNYLKVNRERLRKAYNLLVDALKQVGIECFKSSGGFYCWADMSKFIRSYSEKGERRLWDRLLEEAKVNVTPGSSCHCI

SEQ ID NO: 19879 - protein, 481 aa, Glycine max
  unsure (1)..(481): unsure at all Xaa locations
MFPTSDADACDGQHPSNLPLVLVQIPMCNEREVXHXSIGAASQLDWTKDRILIQVLDDSDDGNLQLFIKEQLALWKEKGVNIVYRHSLIRTVYKVGNLNPTMSSDYVKDYEFVAIFDADFQPNPDFLKLTIPHFKGKPDLGLVQARWSFVNKDENLLTRLQNINLCFHFEVEQQVNGYFLNFFGFNGTAGVWRIKALEESGGWLERTTVEDMDIAVRAHLNGWKFIFLNDVKVLCELPESYEAYKKQQHRWHSGPMQLFRLCLPAILTSKISVWKKANLIFLFFLLRKLILPFYSFTLFCIILPLTMFIPESELPLWVICYVPIIMSFLNILPSPKSVPFLVPYLLFENTMSVTKFNAMISGLFQLGSAYEWVVTKKTGRSSESDLLALAERESKSSNEEKILRRHSESGLELLGKLKQSEAPSKKKRNRLYRKELALALLLLTASARSLLSAHGVHFYFLLFQGLSFLIMGLDLIGEQVS

SEQ ID NO: 19880 - protein, 543 aa, Pseudomonas fluorescens PfO-1
MQTAYTVLILLMLVSVSRLVGRVIPLPLPLVQIAAGALLAWPTLGLHVALDPELFLFLFLPPLLFSDGWRMPKRELWRLRGPVLTLAVGLVLFTVVGAGYFIHWLLPTIPLPVAFALAAVLSPTDAVAVSAISQNRLPTPLMHMLQGEALMNDASGLVTFKFALVAAVTGAFSLANASLTFVLVAVGGLAVGVALSWLVGRLRAWMIARGWDDPATHVVFMLLLPFAAYVLAERLGASGILSAVAAGMMQSWLDLLPRQTSTRLLNRSVWSLLEFAFNGLIFLLLGLQLPDIVKAVVSHETSLWPTLFYRCLDVVAIFLALVLLRFIWVQSIWRLSVLLRRLRGKGDLTQVPTARSCWLLTVGGVRGAVTLAGVMSVPMLMGSEAFPERDLLIFIAAGVILLSLVAACIALPLLLRGIEKSPDDKRRQEVRDAWRKTAEAAIHALETEEVNPQDAAQAALAAELKARIMSEYRHQLEVFNDSAEAQALAFQMDLLERRLRLKALRAQRLELYSLSRQHQIGDDVLREVLGELDLSEANLGSVK

SEQ ID NO: 19881 - protein, 173 aa, Triticum aestivum
  unsure (1)..(173): unsure at all Xaa locations
MAPTVMASSATSVAPFQGLKSTAGLPVSRRSNGASLGSVSNGGRIRCMQVXPSEGIKNSETLSYLPPLNTXGLLKQVDYXIRSKWVPCLXFKQVGFIFRXAQCVSPGYYDGRYWDNVELPMFGXCTDATQVXNEWRSQEGLPDAYVRIIGFDNMRKCNASAQCLQATGCDPAR

SEQ ID NO: 19882 - protein, 193 aa, Triticum aestivum
  unsure (1)..(193): unsure at all Xaa locations
MAPTVMASSATSVAPFQGLKSTAGLPVSRRSNGASLGSVSNGGRIRCMQVWPIEGIXKKFETLSYLPTAQHGRPSLKARSNYLIRSKWGALASSSTRVGFNFREQNATPGXYYDGRYWXTMWKLPMFGXCNDATQVYERXEEVKKDYPDAYVRIIGXDNMRQVQCVSFIRXSKPPGCEGVPARPKQSLNDRHI

SEQ ID NO: 19883 - protein, 407 aa, Oryza sativa; identical to SEQ ID NO: 17827

SEQ ID NO: 19884 - protein, 118 aa, Glycine max
FGSSDEVFTFAKNIAAPYDLVMQTKQLGRLPVVHFAAGGVATPADAALMMQLGCDGVFVGSGVFKSGDPAKRARAIVQAVTHYSDPEILAEVSCGLGEAMVGINLTDDKVERFANRSE

SEQ ID NO: 19885 - protein, 178 aa, Glycine max
  unsure (1)..(178): unsure at all Xaa locations
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 19886 - protein, 315 aa, Escherichia coli K12 [sequence omitted]

SEQ ID NO: 19887 - protein, 332 aa, Nostoc sp. PCC 7120
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEDPGVLSVTTIYNYYKKFGYKTEVMGASFRNIGEITELAGSDLLTISPGLLGELQATIGELPRKLDPAKAATLDIDKISIDKATFDKMHAADRMAYDKLDEGIKGFTKALEELETLLAERLARLEVVASH

SEQ ID NO: 19888 - protein, 445 aa, Xylella fastidiosa Dixon
MVLWYCSLLWLLTGPMTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 19889 - protein, 312 aa, Oryza sativa (japonica cultivar-group)
MAIPKVDLRGLEPGTPGWEAARATVTASMVSHGCVVVAHGELGADLREALFGRAVREAFALPAEAKRRNVSTVGPYRGYIANIPGMDWESLRVHDADDAARVREFAGLLWPEGNPEFCETIVSFATKMRDLERTVERMTLEGLGVGEDHIASHLAAQDYGVRLSHYGPPPDASTAISLQAHRDDSMTTIIVQHEVEGLEVQAGDGSWHAIPPEPDTIAIVAGELFRVVTNGRVPASVHRVRTPSGRERYCVLVGSRSKDGAVLSAMDELVDGEHPLAYRPCKAEEFIQFRYSEEGRKFSDPLKAFCGVNATE

SEQ ID NO: 19890 - protein, 207 aa, Prochlorococcus marinus str. MIT 9313
MRPVALISLIAGLLTLSLAVFNALTVDLVTPSFQRAEVLAGVAAVGLMLMAVLWTQASPMAPSKQILEGNQRFELVDGLNDELQKELAWGSHLLLTATPAAVILVYWNNQVLLRRGISGNGKFVPGEICRQARDRGELISLVNTSLFPGRIEFNPIIENLPAVMVYPLASNGWVVLGGCSERCFSRSDELWLIGWSQRLRTELEERT

SEQ ID NO: 19891 - protein, 178 aa, Oryza sativa (japonica cultivar-group)
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 19892 - protein, 386 aa, Gossypium hirsutum
MDQVQHPSVMQKVAGQLFRSSHSQDFQGYNGSFRSPALYQRRAAYGNYSNAALQHPVRAFGDLSMVPSTASAICVQAPAEKGFSSFAIDFLMGGVSAAVSKTAAAPIERVKLLIQNQDEMIKSGRLSEPYKGIGDCFKRTIKDEGFGSLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLKSDGIAGLYRGFNISCVGIIVYRGLYFGMYDSLKPVLLTGSMQDSFFASFVLGWLITNGAALASYPIDTVRRRMMMTSGKAVKYKSSLDAFSQILKNEGGKSLFKGAGSNILRAIAGAGVLAGYDKLQLIVFGKKYGSGGA

SEQ ID NO: 19893 - protein, 242 aa, Amaranthus quitensis
EREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLS

SEQ ID NO: 19894 - protein, 507 aa, Xanthomonas campestris pv. phaseoli
MRPGHLMVLALLAPTLIAPPVFAQSVLTRDNGAKVGDNQNSQTAGATGPTLLQDVQLIQKLQRFDRERIPERVVHARGTGVKGEFTATADLSSLTKAKVFSAGEKTPVFVRFSSVVHGNHSPETLRDPHGFATKFYTSEGNWDLVGNNFPTFFIRDAIKFPDMVHAFKPDPRTNLDDDSRRFDFFSHVPEATRTLTLLYSNEGTPAGYRFMDGNGVHAYKLVNAQGEVHYVKFHWKTLQGIKNLDPKQVAAVQAKDYSHLTNDLVGAIKKGDYPKWDLYVQVLKPEDLAKFDFDPLDATKIWPDVPEQKVGQMVLNKNVDNFFQETEQVAMAPANLVPGIEPSEDRLLQGRIFSYADTQLYRIGANGLSLPVNRPRVAVNNGNQDGQGNIGQTTSGVNYEPSRLEPRPQDTAARYSELPLSGTTQQAKITREQNFKQAGELYRSYSKKDRADLVQSFGESLATTDTESKHLMLSFLYKADPEYGTGVTRVAKGDLARVKQLASSLQD

SEQ ID NO: 19895 - protein, 367 aa, Rhodobacter sphaeroides
MTGPRYTPLVESLPSTVPFVGPETQERARGRPFRARLGANESLFGPSPHAVAAMAAAAAEVSLYGDPEIHALRTAIAAHHGVAPDQVTVGEGVDGLLGNLVRLLVDEGAPVVTSEGAYPTFAFHVAGFGGRLHKVPYQGDHEDPEALAAEARRVGARIVYFANPDNPMGSHHPAASVRALIEALPEGTLLALDEAYVELAPEGTAPEIAPEDPRVIRFRTFSKAYGMAGLRVGYAIGARDLIRAFDKVRNHFGVGRIAQAGALAALEDRAWLAHVQAEVQAARAEIGRIAEGCGLTPLPSATNFVTIDCGRDGAFARAVLTELVARDIFVRMPFVAPHDRCIRVSCGRAEELRAFAEALPLALAAAG

SEQ ID NO: 19896 - protein, 427 aa, Lemanea borealis
IEASAAIAGESSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAAAGEIKGHYLNVTAATMEDMYERAEFAKELGSIICMIDLVIGYAAIQSMAIWARKTDMILHLHRAGNSTYSRQKIHGMNFRVICKWMRMAGVDHIHAGTVVGKLEGDPLMIKGFYDTLLMSHLDVNLPHGIFFEQNWASLRKVTPVASGGIHCGQMHQLLDYLGDDVVLQFGGGTIGHPDGIQAGATANRVALESMVMARNEGRDYVTEGPQILRDAAKTCGPLQTALDLWKDISFNYTSTDTADFV

SEQ ID NO: 19897 - protein, 429 aa, Synechocystis sp.
MKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRGMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 19898 - protein, 141 aa, Oryza sativa
MISARRLAQLAKKWQRMAALERKRLTMKAKENEECCTSVAGKGHCVMYTADGSRFEVPLAYLGTAVFSELLRMSQEEFGFTSDGRIMLPCDAVVMEYAMCLLKRNASAEVEKALLSSMVAPCHYTGCMVPTVGVNQHISCL

SEQ ID NO: 19899 - protein, 227 aa, Zea mays
  unsure (1)..(227): unsure at all Xaa locations
MGAFFSKQVDRRKLVAAEKRALATRLSSSGDTFPGXEHRPADRKRWMAELGAGRLRVHQVVWPGTHDSATDRIGVPFVTRPFAQCQSLSVYEQLPLGARVLDVRVQKGRRVCHGVLATYPVDVVLDDVARFLGETESEVVVLEVRTEFGHEDPPEFGRFLVERLGEHLLIPQDKAVFHKTVAELLPRRVICVWKPRRSPAPGPGDPLWSAGRTRGRTRGRTRGRTRG

SEQ ID NO: 19900 - protein, 223 aa, Triticum aestivum
  unsure (1)..(223): unsure at all Xaa locations
REQKLELHRGGGRSRTSGSPGLQEFGTRANSDNLGAIVDIKILNHLITNQNEYCMEVTPKTLADVKGGTLISYEGRVQLLEIAQVPDEHVNEFKSIEKFKIFNTNNLWVNLKAIKRLVDAEALXKMEIIPNPKEVDGVKVLQLETAAGAAIRFFEKAIGINVPRSRFLPVKATSDLLLVQSDLYTLVDGYVIXRNPARVKPSNPSIELGPEFKKVXNXLCRFK

SEQ ID NO: 19901 - protein, 705 aa, Emericella nidulans
MSAETSTTPAPAENTNGTPDNAPAPEVTAVEAPATTSQPHSASLYVGELDPSVTEAMLYELFSSIGQVASIRVCRDAVTRRSLGYAYVNYNDTAHGERALDELNYTLIKGKPCRIMWSQRDPALRKTGQGNVFIKNLDSAIDNKALHDTFAAFGNILSCKVAQDEFGVSKGYGFVHYETAEAANNAIKHVNGMLLNDKKVFVGHHISKKDRQSKFEEMKANFTNIYIKNIDPEVEDEEFRKLFEKFGEITSATLSRDSEGKSRGFGFVNFSTHESAQAAVEEMNDKEVRSQKLYVGRAQKKHEREEELRKQYEAARMEKASKYQGVNLYVKNLTDDVDDDKLRELFGPYGTITSAKVMRDTAPVETATPESETKESANKENEKAAEGEKEPAAEEKEKEEEKEAEQKPEKKPLGKSKGFGFVCFSSPDEASKAVTEMNQRMVNGKPLYVALAQRKDVRRSQLEASIQARNNIRQQQAAAAAGMGQAYMAPAVFYGPGQQGFIPGAQRGGMFPPQPGMMMGMPGRPGQYPGPFPGQQGGRGVGPNQQIPPNFQGLPMGAMQGPGIPNGMGYPMVQGQFGGGRGRGQVPGMGGPMRGGYGGGRGGVPLGGQMRPGQGGRGQAVGQPGPETPVGVLTAQALSAAPPQQQKQMLGEALYPKIQATQPELAGKITGMLLEMDNTELLGLLRMTRLCAPRSTKPLAFMTST

SEQ ID NO: 19902 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 19903 - protein, 466 aa, Brucella melitensis 16M
MPASTPKGNISERAPTASEKEALDFHAQGRPGKLEINPTKPMTTQRDLSLAYSPGVAVPVKAIAEDAARAYDYTAKGNLVAVISNGTAILGLGNLGALASKPVMEGKAVLFKRFADVDSIDLEIDTTDIDAFINAVRYLGPSFGGINLEDIKAPDCFIIESRLRELMDIPVFHDDQHGTAIIAAAGLINALHLTGRDMKTTKLVCNGAGSAGIACIELIKAMGFAPENVILCDTKGVVYQGREEGMNQWKSAHAVKTDRRSLANAMKDADVFFGVSAKGALTQDMVRSMAPNPIIFAMANPDPEITPEEVERIRDDAIVATGRSDYPNQVNNVLGFPYIFRGALDVRATTINDAMKIAAVNALAELAREDVPDDVVAAIRAAARALGRTISFRCRSIRACLPPFPPPSPRLRWKPAWPGAPLPILKATSANCWRAATRSPRRCAAFTSVCAASQSASYLPKARKNR

SEQ ID NO: 19904 - protein, 469 aa, Glycine max; identical to SEQ ID NO: 10891

SEQ ID NO: 19905 - protein, 425 aa, Magnetococcus sp. MC-1
MADKSKNGVANLNEAIRQSLILVLAGGRGSRLKNLTDTEAKPAVPFAGKFRIIDFALSNCVNSGMRRVGVLTQYRAHNLIQHVQRGWGSFRAEFDEFVEVWPAQQQTAAESWYSGTADAVYQNIDLIESHHPKYVVILGGDHIYKQDYSVMLDHHITSGAQVTVACLEVPVAEAREFGVMDVDEQDQIVKFLEKPQTPPELPNRPGWALASMGIYIFDHELLVEQLERDALLEDSSHDFGKDLIPYLVPKVKVMAHRFSHSCVGLDGKKEPYWRDVGTLDAYWEANMDLTHVTPELDLYDPKWPIWTYQVQRPAAKFVFNDDSRRGYAVDSLVSAGCVVSGSAVERSLLFTDVRVNSYSFVSDSVILSHADIGRKCTLIKCIVGPNTVIPDGMVIGKDPQLDAQRFYRTEGGVTLVTQEHIDKLK

SEQ ID NO: 19906 - protein, 408 aa, Prochlorococcus marinus subsp. marinus str. CCMP1375
MVQVNSNYLKLKAGYLFPEISRRVNAFCELNPTASLIRLGIGDVTEPLPQACCKAMKTAIEEMGSTSGFRGYGPEQGYLWLREAIAKNDFQSRGCQISADEIFVSDGSKCDSSNILDILGTGNKIAVTDPVYPVYVDSNVMAGQTGIAASSGHYEGLVYIPLNAENGFEAELPSEPVDLIYLCFPNNPTGAVASKVQLTKWVEYAKKNHALILFDAAYESFIQDPLLPHSIFEIDGATDCAIEFRSFSKNAGFTGTRCAFTVIPKSLKGKTLDGAEVDFWSLWNRRQSTKFNGVSYIVQRGAEAVYSLEGQSQTNKLVSFYMKNAEIIRKQLTLAGYKIYGGKHAPYVWLEAPTEMDSWQFFDHLLNKANIVGTPGSGFGVAGEGYFRLSAFNSRSNVEEAMRRITSI

SEQ ID NO: 19907 - protein, 324 aa, Zea mays
  unsure (1)..(324): unsure at all Xaa locations
QVLAATQMPEEPAGWFXGYSHKSIDNIVILSGDQLYRMNYMELVQXHVEDDVDITISCAPVDESRASKXGLVKIDHTGRVLQFFEKPXGADLNSMRVETNFLSYAIDDAQKYPYLASMGIYVFKKDALLDLLKSKYTQLHDFGSEILPRAVLDHSVQACIFTGYWEDVGTIKSFFGANLALTEQPSKFDFYDPKTPFFTAPRCLPPTQLDKCKMKYAFISDDGCLLRECNIEHSVIGVCSRVSSGCELKDSVMMGADIYETEEEASKLLLAGKVPVGIGRNTKIRNCIIDMNARIGKNVVITNSKGIQEADHPEEGYYIRSGIV

SEQ ID NO: 19908 - protein, 280 aa, Solanum tuberosum
SLGSSTLLQSQISGFGGSQKLQKISFSNPNSLTFTRRRIQTVVNASSRVDKFSKSDIIVSPSILSANFSKLGEQVKAIEQAGCDWIHVDVMDGRFVPNITIGPLVVDSLRPITDLPLDVHLMIVEPDQRVPDFIKAGADIVSVHCEQSSTIHLHRTINQIKSLGAKAGVVLNPGTPLTAIEYVLDAVDLVLIMSVNPGFGGQSFIESQVKKISDLRKICAERGLNPWIEVDGGVGPKNAYKVIEAGANALVAGSAVFGAPDYAEAIKGIKTSKRPEAVAV

SEQ ID NO: 19909 - protein, 284 aa, Glycine max
  unsure (1)..(284): unsure at all Xaa locations
MYRERGGVGSKSEVTSVDRKRINDVLDKQLERSSPSTSRAAAMQRQGPLLLFPLSRXKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSNGMAAMLDKYKNYDFGRCPRVYCSGQPCLPVGQSDVPRSSTVKIYCPRCEDIYYPKSKYQDIDGAYFGATFPHLFLMTYGNLKPQKQSQNYVPRVFGFKVHKS

SEQ ID NO: 19910 - protein, 130 aa, Synechococcus sp. PCC 7942
MLLSHPDRQALKALDHQLSNRFIKLDPEGYFVIYLDREAGLICADHYSNAINDKGLATDPETGEVLACKGNLKRVPTATFRGRTAKELGKLITEDTQPCPLSYLDHALYLGREFQRAEACLLSGQDYVQD

SEQ ID NO: 19911 - protein, 427 aa, Malus x domestica
MAYHNHLSQDLPLHHFTDQTHHQHQQYQSDQPDPNSKPPEPHHSFQPAPNWLNSALLRNFTNTDTNPTNSNNANNNGGGVSNFLNLHVTASDSAASQASNQWLSQSHRPILHRNHSDVNDDVTVAGDSMIAAALSHDSADLKPDSILNKNEGGGGDGGVMNWQNARHKAEILAHPLYEPLLSAHVACLRIATPVDQLPRIDAQLAQSQNVVAKYSALGNGMVGDDKELDQFMRNYVLLLCSFKEQLQQHVRVHAMEAVMACWEIEQSLQSLTGVSPGEGTSATMSDDEDDQVDSDANLFDEGMEGHDSMGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSTSTVLKSKRKR

SEQ ID NO: 19912 - protein, 490 aa, SYNECHOCOCCUS SP. WH 8102
MTTAFHSPTSRRRKTLQEANLLEGPLMLIKSIRGFSSNRAMTWLACAPLALMGLGIFTLSAKAEELPDLNAAFLANNLWLLVATILVIFMNAGFAMVEAGMCRQKNAVNILAKNLFVFALAVTAYWFVGYSFMYGDAAIDGWLYFGGLFFDPTVTAETISDAGLVPTVDFLFQAAFAGTAATIVSGLVAERIKFGEFVVFALILTAFIYPVAGSWEWNGGWLNSVGNAEFIDFAGSSIVHSVGAWAGLVGAALLGPRIGKYVGGNVQAIPGHNMSIATLGALILWIGWYGFNPGSQLAMDQWVPYVAVTTTLGAAGGAIGATVISTITSKKPDLTMIINGILAGLVSVTAGCGNLTLTGSWVAGLVGGIIVVFSVSALDSAGIDDPVGAFSVHGVCGVWGTLVIGLWGFDVQGDGSPLGLLVGGGIEQLGIQALGTAAYAIWTVVTCFIAWQIIGALFGGIRVTEQEETEGLDIGEHGMEAYAGFSTTNN

SEQ ID NO: 19913 - protein, 196 aa, Burkholderia multivorans
IHFDVMDNHYVPNLTIGPLVCEAIRPHVQVPIDVHLMVRPVDRIVPDFAKAGANLISFHPEGSDHIDRTLTLIRDHGCKAGLVFNPATPLNYLDHVMDRLDYVLLMSVNPGFGGQSFIPETLNKLREARARIDAYTERTGREILLEVDGGVKADNIAEIAAAGADTFVAGSAIFGKPDYRKVIDEMRAALAAVERS

SEQ ID NO: 19914 - protein, 524 aa, Oryza sativa (japonica cultivar-group)
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLSLRYADTLSLCSVSFRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 19915 - protein, 180 aa, Zea mays
LGTSRPAGARLPGVIIASGGEPSFHLFGFIMCIGATAARALHAPGRVGLLSSDGEKLNSMNLLLYMAPIAVIFLLPATIFMEDNVVGVTIQLAKKDFTIVWLLLFNSCLSYFVNLTNFLVTKHTSALTLQVLGNAKGAVAVVISIMIFRNPVSITGMLGYTLTVFGVILYSESKKRSNKP

SEQ ID NO: 19916 - protein, 502 aa, Oryza sativa; identical to SEQ ID NO: 14363

SEQ ID NO: 19917 - protein, 393 aa, Arabidopsis thaliana
MALSRLSSRSNTFLKPAITALPSSIRRHVSTDSSPITIETAVPFTSHLCESPSRSVETSSEEILAFFRDMARMRRMEIAADSLYKAKLIRGFCHLYDGQEALAVGMEAAITKKDAIITSYRDHCTFIGRGGKLVDAFSELMGRKTGCSHGKGGSMHFYKKDASFYGGHGIVGAQIPLGCGLAFAQKYNKDEAVTFALYGDGAANQGQLFEALNISALWDLPAILVCENNHDGMGTATWRSAKSPAYFKRGDYVPGLKVDGMDALAVKQACKFAKEHALKNGPIILEMDTYRYHGHSMSDPGSTYRTRDEISGVRQVRDPIERVRKLLLTHDIATEKELKDMEKEIRKEVDDAVAQAKESPIPDASELFTNMYVKDCGVESFGADRKELKVTLP

SEQ ID NO: 19918 - protein, 729 aa, Brucella suis 1330
MPKYKDLVPHSFWREIVPTTEDRAAFDLALGGTMLSQMHLIRAFEEKVLELAGQGLVHGPAHSAIGQEGGAVGSAVSMRPSDQINGSHRAHHQFLAKALGYVAQKGIDPKAAFDQDIRTLAQRTLAEILGLSQGFCRGRGGSMHLRWAESGNLGTNAIVGGGVPMAAGAAWAHRRAGKGDVVYTYFGDGATNIGSVLETMNLAAAWKLPICFFIENNRYAVSTHVEEVTAEPRLSSRGLAFGIPSFKVDGMDPIAVWLASEEANAIMRAGNGPTIIEADVYRYFHQNGPLPGSAFGYRSKDEEAEWRGRDPLDALAKTLLERQALGEDAIKALRERCVSLMDEVAGQLIEMHDGKRRIIPSLWPEESFRDFGLRGDLSEFDGVRFEEQESFSGKLVEDARFIDTVADVMARRMETDERVVVLGEDVHRLKGGTNGATRGLSADYPDRVLGTPISENAFTGIAGGMAADGRVLPVIEFMYPDFMWVAADQVFNQIGKARHMFGGDSDMPVVLRTKVAMGTGYGSQHSMDPAGIFATAPGWRIVAPSTPFDYVGLMNSALLCRDPVLVLEHVDLYASKGAAPAEDFDYFIPLGEAKVVRPGSRVTVLTYLAMVAKTQAVVEALGVDAEIIDLRSLDRAGVDWETIEASVRKTGNVLIVEQGASGTSYGGWLADELQRRCFDWLDQPIARVHGAEASPSISKVLEAAAAARPQDIEAGLRAVMAAQGLPIEN

SEQ ID NO: 19919 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 19920 - protein, 357 aa, Zea mays; identical to SEQ ID NO: 2278

SEQ ID NO: 19921 - protein, 687 aa, Yersinia pestis CO92
MKRLTLPLLLVLSPAAMANWSLQHFPAFTEQDSGIFLSSSSLTKGEYPLKFYQDKQCWQPTGPVKLNQMLSLQPCQENIAIPWRLFRDGQYQARIDTRSGTPTLTLSVTAPVAEAVQVVTHVCQRWDGNPVTVDVSKTFAEGEIVRDFYSGQTATVSLGKITLRPAPESGGLLLLESAQTQQAAPFSWQNATVYFALTDRFNNGNPANDHSYGRHGDGMQEIGTFHGGDLAGLTEKLDYLQQLGVNALWISSPLEQIHGWVGGGTKGDFPHYAYHGYYGLDWTRLDANMGTEQDLRTLVEQAHKRGIRILFDVVMNHVGYATLADMQNDQFGALYLQGDQQEKTLGKRWSDWTPGSGQTWHSFNDYINFSDKTAWDNWWGKKWIRTDIGDYDTPGYDDLTMSLAFLPDIKTESTQPSGLPVFYRNKPDTAAQEIAGATPRDYMTHWLSQWVRDYGIDGFRVDTAKHVEKPAWQQLKQQSIAALAEWKAAHPEQALDNLPFWMTGEAWGHGVMKSDYYQNGFDAMINFDFQDQANQALACFSSIESTYNQMAEKLQNFNVLSYLSSHDTRLFFKDDAQQSLAKQQRAGSLLLLAPGAVQIFYGDESGRKFGPTGSDPLQGTRSDMNWSELSGEKGALLAHWQKVSQFRARHPAIGAGVQQSQQTANYYAFSRQHQGDKVLVVWVGDKN

SEQ ID NO: 19922 - protein, 193 aa, Triticum aestivum
MAFASSLLPAPASGVRASHAPELAFPPVNRKGGVSLRRRGARHGVRAEVNESASALAIDALSQVKHVLLPITDRNPYLSEGTRQAAATTTSLAKKYGANITVVVIDDKPKESFPEHDTQMSSIRWHLSEGGFTEFGLMERLGEGKKPTAIIAEVADDLELDLVVLSMEAIHSKQVDGNLLAEFIPCPILMLPL

SEQ ID NO: 19923 - protein, 782 aa, Oryza sativa
  unsure (1)..(782): unsure at all Xaa locations
MSDQERDDIPMLLRNVELPTFPPRSTSMCIPVRDDEYEEDTFVPHTGPLFVQPPTQTAAAGIPFTNTPDMPPRPPQGKQVNKPHAIMPEEIGGNRWSYSGNVPKNEHLMMSGPLGQCDDPDCVNCPPACKNKRHFHRGSSTLDSKFHNFLCEHGGGWKKEIERFLSRIPVMNPHAKVVQQWNQFFVISCLVAIFIDPLFFFLLSVQKDNKCIVLNWHFATALAVVRSVTDAIYFLHMLLQFRLAYVAPESRVVGAGDLVDEPKKIAVRYLRGYFLLDFFVVLPLPQVMILLVIPKYVGLSTANYAKNLLRITVLLQYVPRIIRFVPLLGGQSDSSANGFIFESAWANFVINLLMFVLAGHVVGSCWYLFGLQRVNQCLRNACSASKIPSCDGFIDCGRGINIGKQNQLSRQQWFNDSASTACFDTGDNGFHYGIYEQAVLLTTEDNAVKRYIYSLFWGFQQISTLAGNLVPSYFAWEVLFTMAIIGLGLLLFALLIGNMQNFLQALGRRRLEMQLRRRDVEQWMSHRRLPEDLRRRVRRAEMFSRAATQGVNEEELLSNLPEDIQRDIRRHFFRFLNKVRLFTLMDWPILDAICDKLRQNLYISGSDILYQGGPVEKMVFIVEGXLEKHPVQMEAKLPLHEGDVCGEELLTWYLEHSSANRGLQYISIVSDGGRMRFHGMRLVAIRTVRCLTNVEAFVLRASDLEEVTSQFSRFLRNPRVQGAIRYESPYWRTIAATRIQVAWRYRNRRLKRAGMSKLNDQSYNSALERGARECDARQHGRV

SEQ ID NO: 19924 - protein, 333 aa, Triticum aestivum
AGGAARGRLPGRRPRSLDPGAISLDVDKPAVSAINPDKEPVSFAGHLKTASALALFPQSNPRTMLSTSYDGVILKWIQGVGYGGRLIRKNNTQIKCFVATEEELITSGYDNKVFRIPVNGDQCGDAESTDVGGQPNALNIALQQPEFALVTTDSAIVLLNKSNVTSTTKVSYTITSSAVSPDGTEAIVGAQDGKLRIYSISGDTVTEEAVLEKHRGPITTIHYSPDVSMFCSADSNREAVAWDRATREVKLKNMLFHTARVNCLAWSPDSRFVATGSLDTCAIIYDVDKPAASRTTIKGAHLGGVHGISFADNDTLVTAGEDACIRVWKLAQQ

SEQ ID NO: 19925 - protein, 368 aa, Saccharomyces cerevisiae
MARTITFDIPSQYKLVDLIGEGAYGTVCSAIHKPSGIKVAIKKIQPFSKKLFVTRTIREIKLLRYFHEHENIISILDKVRPVSIDKLNAVYLVEELMETDLQKVINNQNSGFSTLSDDHVQYFTYQILRALKSIHSAQVIHRDIKPSNLLLNSNCDLKVCDFGLARCLASSSDSRETLVGFMTEYVATRWYRAPEIMLTFQEYTTAMDIWSCGCILAEMVSGKPLFPGRDYHHQLWLILEVLGTPSFEDFNQIKSKRAKEYIANLPMRPPLPWETVWSKTDLNPDMIDLLDKMLQFNPDKRISAAEALRHPYLAMYHDPSDEPEYPPLNLDDEFWKLDNKIMRPEEEEEVPIEMLKDMLYDELMKTME

SEQ ID NO: 19926 - protein, 191 aa, Triticum aestivum
  unsure (1)..(191): unsure at all Xaa locations
QGGFDVAGPRGAAQQQIVYGVFGYMQVLSACFMSFAPHGGDDANDVGGPLAAALSLLQGVASSAEIVIPTEVLAWGGFGICRRGLQSWGYRVXIAPIGKKIPRINXPTRGFAAEFAAASVVLFASKLGLPISATHTLVGAVMGVGFARGLNRVRAETVREIVVSWVVTIPVGALLSVFYTLILTKILKYFM

SEQ ID NO: 19927 - protein, 296 aa, Salmonella enterica subsp. enterica serovar Typhi Ty2
MSFFHANQREALNQSLAEVQGQINVSFEFFPPRTSEMEQTLWNSIDRLSSLKPKFVSVTYGANSGERDRTHSVIKGIKERTGLEAAPHLTCIDATRDELRTIARDYWNNGIRHIVALRGDLPPGSGKPEMYAADLVGLLKEVADFDISVAAYPEVHPEAKSAQADLLNLKRKVDAGANRAITQFFFDVESYLRFRDRCVSAGIDVEIIPGILPVSNFKQAKKFADMTNVRIPSWMSLMFEGLDDDAETRKLVGANIAMDMVKILSREGVKDFHFYTLNRAEMSYAICHTLGVRPGL

SEQ ID NO: 19928 - protein, 192 aa, Cucumis sativus
TGDEGNNEYKKGLWTVEEDKILMDYVKAHGKGHWNRIAKKTGLKRCGKSCRLRWMNYLSPNVKRGNFTEQEEDLIIRLHKLPGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIN

SEQ ID NO: 19929 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 19930 - protein, 159 aa, Glycine max
  unsure (1)..(159): unsure at all Xaa locations
HDHVIGLRTFLTRDDLAGLQVADGAIPLSXTEYLWRAEHPYHVSPAAEISACAXLPNPTYLEDVKQALLNERGRLYDLFXEVPFLRPFPSHSNSILCEVTSREDGQNLREDLAQMGLMILHYDKKELKGYVRVTVGQPEQTDTLMKCLRRLSDEDNLML

SEQ ID NO: 19931 - protein, 462 aa, Streptomyces avermitilis MA-4680
MKAQDGMYIDGAWRPAAGPDMIEVVNPADEQVIGRVPAGTPEDVDAAVRAARAALTAWAATPPAERAARISALRDVLVARQDEIAETVTAELGSPLSFSQSVQVGLPILVAGSYAELAATYAFEERVGNSTVHHEPVGVVGAITPWNYPLHQIVAKVAPALAAGCTIVLKPAEDTPLTAQLFAEAVHEAGVPAGVFNLVTGLGPVAGQALAEHEDVDLVSFTGSTAVGRQIGATAGAAVKRVALELGGKSANVILPSADLAKAVNVGVANVMANSGQTCSAWTRMLVHAERYEEAVELAAAAAVKYADRIGPLVNAKQRARVRGYIDKGVAEGARLVAGGPESTEPQGYFVSPTVFADVTPEMTIAKEEIFGPVLSVIRYEDEEEALRIANGTVYGLAGAVWAGDEAEAVAFARRLDTGQVDINGGRFNPLAPFGGYKQSGVGRELGAHGLAEYLQTKSLQF

SEQ ID NO: 19932 - protein, 330 aa, Glycine max
DYLFLRRLTFFLSGKVLNFSYGLLLSFVFYSFEIWIFFQGIGVVKQPMEGSKPPPPPPPPMLERRARPQKDQALNCPRCNSTNTKFCYYNNYSLSQPRYFCKTCRRYWTEGGSLRNVPVGGGSRKNKRSTPPAPPSAPAPTKKLSDLATPNFPQSASQDPKIQQGQDLNLAYPPAEDYSTVSMSKLIEVPYSTELDKGTTGLHQNPTSSSTTTSASSQLSAMELLKTGIAAASSRGLNSFMPMYNSTHGFPLQDFKPPHGLNFSLEGFENGYGGLQGIQEGPTGGARILFPTVEDLKQQVPSTNEFDQQNRSQEGSAHGYWNGMLGGGSW

SEQ ID NO: 19933 - protein, 472 aa, Neisseria gonorrhoeae
MSIKNAVKLIEKSKARFVDLRFTDTKGKQHHFTVPARIVLEGPEEWFENGQAFDGSSIGGWKGIQASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 19934 - protein, 545 aa, Zea mays
MSMGYQVVAAQLKVASSADHASVVIITLFVALLCACIVLGHLLEENRWLNESITALIIGLCTGGVILMTTKGKSSHVFVFSEVLFFIYLLPPIIFNAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 19935 - protein, 572 aa, Shewanella oneidensis MR-1
MEKLSGASMIVRSLIDEGVKHIFGYPGGSVLDIYDALHLIPGIEHILVRHEQAAVHMADGYARATGKVGVVLVTSGPGATNAITGIATAYMDSIPLVVLSGQVPSNLIGNDAFQECDMIGISRPVVKHSFLVQDPTQIPEIIKKAFYIASTGRPGPVVVDLPKDCLNPALLHDYIYPESIKMRSYNPTTSGHKGQIRRGLQALLAAKKPVLYVGGGAIISGSEKQILTLAEKLNIPVISTLMGLGAFPGTHKNSLGMLGMHGRYEANMAMHNCDLIFGIGVRFDDRTTNNIEKYCPNATILHIDIDPSSISKTVRVDIPIVGSADIVLDSILALLDEASETNDFVAINQWWQEITTWRNRQCLAYDKESNRIKPQQVIETLYKLTNGEAYVASDVGQHQMFAALYYPFDKPRRWINSGGLGTMGFGLPAAMGVKMAMPDETVVCVTGDGSIQMNIQELSTALQYDTPVKIINLNNRFLGMVKQWQDMIYSGRHSHSYMDSVPNFAKIAEAYGHVGMTISDPAELESKMAEALAMKDRLVFIDIMVDETEHVYPMLIRGGAMNEMWLSKTEKC

SEQ ID NO: 19936 - protein, 512 aa, Candida tropicalis
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 19937 - protein, 500 aa, Salmonella typhimurium LT2
MLKRKKIKPITLGDVTIIDDGKLRKAITAASLGNAMEWFDFGVYGFVAYALGKVFFPGADPSVQMIAALATFSVPFLIRPLGGLFFGMLGDKYGRQKILAITIVIMSISTFCIGLIPSYATIGIWAPILLLLCKMAQGFSVGGEYTGASIFVAEYSPDRKRGFMGSWLDFGSIAGFVLGAGVVVLISTIVGEENFLEWGWRIPFFIALPLGIIGLYLRHALEETPAFQQHVDKLEQGDREGLQDGPKVSFKEIATKHWRSLLSCIGLVIATNVTYYMLLTYMPSYLSHNLHYSEDHGVLIIIAIMIGMLFVQPVMGLLSDRFGRRPFVIMGSIALFALAIPAFILINSNVIGLIFAGLLMLAVILNCFTGVMASTLPAMFPTHIRYSALAAAFNISVLIAGLTPTLAAWLVESSQDLMMPAYYLMVIAVIGLITGISMKETANRPLKGATPAASDIQEAKEILGEHYDNIEQKIDDIDQEIAELQVKRSRLVQQHPRIDE

SEQ ID NO: 19938 - protein, 400 aa, Zea mays
  unsure (1)..(400): unsure at all Xaa locations
MARSWLITCRGIAKKIRYANPSANRQISQLIAEARRECPNCSYVIDNSDVAMQWPGXLPAGVKFDPSELELLQHLEQKVGLGDSRPHVLIDEFIPTIDNDEGICYSHPENLPGMKTDGSNAHFFHRVSKAYGYGQRKRRRIINCSDHTVPDDRVRWHKTGRSKAIYDNGVIKGWKKIMVLHKTLRSGGKRERAKWVMHQYHLGKEEDEKDGELVVSKIFFQLANKSMEISETETACEEPEAPASVIGPKTPKTITPQPRHPKSSPCETQQNISIVQDQLLLDSEGEPTMPIVSLEDDAMNPAWCAVAEERQVVGEASRAQSNSVETLLCREDPNSLNYEALLPWDYPILSQCRNEMLDGNLNGYGLPDHHNVDLGTPPDLQLADFQFGSQESLGSWLDRI

SEQ ID NO: 19939 - protein, 437 aa, Mesembryanthemum crystallinum
MEMERVTEFPLTHHLDRRRRKRARLGWDVAPQISKAQIGIFCGQEVGNVTSFAPSAAPSEHTTTTSSLFSKGVARNGSPRQGGMMTKMGITCLSFGENLTSRYKIHGKMGEGTFGQVLECWDRERKEMVAIKIVRGIKKYREAAMIEIDVLQQLGKHDKGGSRCVQIRNWFDYRNHICIVFEKLGSSLYDFLRKNNYGPFPIDLVRENGRQLLDCVAFMHDLHLIHTDLKPENVLLVSSDYVKIRDYKGFSRSPKDSSYYKKVPKSSAIKVIDFGSTTYERPDQNYIVSTRHYRAPEVILGLGWSYPCDVWSVGCILVELCSGEALFQTHENLEDLAMMERVLGPLPQHMLKRVDRHAEKYVRRGRLDWPEGAASRESIRAVTKLLRLQNLVMQHVDHSGGDFIHLLQGLLRYDPSDRLTAREAVRHPFFTRDNLRR

SEQ ID NO: 19940 - protein, 114 aa, Klebsiella pneumoniae
SLYDIAPVTPGVAVDLSHIPTDVKIKGFSGEDATPALEGADVVLISAGVARKPGMDRSDLFNVNAGIVKNLVQQIAKTCPQACIGIITNPVNTTVAIAAEVLKKAGVYDKNKLF

SEQ ID NO: 19941 - protein, 428 aa, Novosphingobium aromaticivorans
MTAIIDIHAREILDSRGNPTVEVDVLLEDGSFGRAAVPSGASTGAHEAVELRDGDKARYLGKGVTKAVTAVNSDIAECILGLDAEDQRDIDLAMIELDGTENKSRLGANAILGTSLAVAKAAADARGLPLYSYVGGVSAHVLPVPMMNIINGGEHADNPIDFQEFMIMPVGAPSLAEAVRWGAEVFHTLKKGLHEKGLATAVGDEGGFAPNLASTRDALDFVMASIEKAGFKPGEDMMLALDCAATEFFKNGKYEISGEGLSLSPDAMADYLAALCDAYPIISIEDGMGEDDFEGWAALTAKVGKRVQLVGDDLFVTNPKRLEMGIGKGLANSLLVKVNQIGSLTETLEAVSIAQRNGYTAVMSHRSGETEDATIADLAVATNCGQIKTGSLARSDRLAKYNQLIRIEEELGVSARYAGKTAFGRLGA

SEQ ID NO: 19942 - protein, 618 aa, Rhizobium sp. NGR234
MPNVQSLAIIVTDPRLIISTWKDRCPAPLSSVGGMPILARLVSQLAQAGVQKTIVFALDGIGDVKRILNNRMKRMELVIRIMPTPGSGRLIDLATITEIAEFHGQVLVFTENAVIDPSLIQRLLRSSDRNITVVSRSERRRCLRLLGDIGGRLTAMLPGDSPIRESASADVSPVGIYKFDPALLRAIARIRPHRFNDDLEFFETALGLQRHQIYLMYADPQHVRRVNDATDLEAANFASSSSGDQFSILERLQAGNWRYPASEHILLCNHHFPPASVVDRLRERLQDLLYLQPSDQLDIIAKLSEMTDLPARNLAVGNGVGELIKALYGYLDPRIVIPTPTSAQYIDAVEPNKVSRFELPPENFDLDVEAFANFAKRRQASVAVLVNPNNPTGRLVPVQEIEWLASQLAIEKCRLVVDETFIEFSVAGKGNSVEKLLSVFPKMVILKSLGAIMGLGGAQIGYLASKDEQLTHGVRRRLPLGNINGIAEYLLWILPEFREEWEASFRRTRADVVSFSRMLDTIPELEVHPSQANYLFCRTPEAWPSAKHVATMLAKRYGVLVQNCENQCMKYGDRYLRLTVLPYEENRYLVSALRRINEELVEWSTQSKRAGTAYHLGC

SEQ ID NO: 19943 - protein, 394 aa, Lactobacillus plantarum WCFS1
MDFLGILCLLILATTLAGHFAHRAGIPAVIGEILVGVILGPALLNWVHLTTLVQTFSDIGVVVLMFIGGLESNLALLRKYLRPAIIVAIIGVIFPVVIMGLASRFFQFSWFESLFIGVIFSATSVSISVEVLKEFKVLDTKEGATILGAAVADDIIGVILLSIMIAMMGGQSGVAQTNLGIVLLEQVGFFIGVFIVIKWVAPYLMRLSDHLLMAASPTIMAIIICLALAWLAELVGLSGAIGAFFAGVAIAQTDYQHVVDVSIEPVGYTTFIPLFFVSVGLNMTFKGVWQSLPFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIEEH

SEQ ID NO: 19944 - protein, 315 aa, Musa acuminata
MDCSFPVINMEKLQGGEREKAMELLRDACENWGFFELLNHGISPELMDEVERLTKEHYRKCREQKFKEFASKALENGSEVTDVDWESTFFLADLPVSNMSELVDMGADYRKVMKEFAAKLEMLADGLLDLLCENLGLEKGYLKKAFCGSKGPSFGTKVSAYPPCPRPELIKGLRAHTDAGGIILLFQDDRVSGLQLLKDGQWVDGPPMRHSIVVNLGDQLEVITNGKYKSVLHRVVALTDGNRMSIASFYNPGSDAVVFPAPTLVQKEAEKDDAAAVYPRFVFEDYMKLYVIQKFQAKEPRFEAMKATALPIPTS

SEQ ID NO: 19945 - protein, 132 aa, Zea mays
VILDSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQAFIEVCLVFHDRPVVLNLIREHNLLQHT

SEQ ID NO: 19946 - protein, 375 aa, Oryza sativa
MAFHGHLPHEMTMQALGADDAAVAAAAAAGGVGAGGAPAWMRYNDGSFLHLQTTSDSSASPSGAAAAAAAAAAAAAAGVQQWMGGGGGGEDAVAAAMGGGGEADAARCKAEILAHPLYEQLLSAHVACLRIATPVDQLPRIDAQLAQSQGVVAKYSALAAAAAGDDGRELDQFMTHYVLLLCSFKEQLQQHVRVHAMEAVMACWELEQNLQSLTGASPGEGTGATMSDGEDDQADSEANMYDPSLDGADNMGFGLPTESERSLMERVRQELKHELKQGYKEKLIDIREEILRKRRAGKLPGDTTSTLKAWWQSHAKWPYPTEEDKARLVQETGLQLKQINNWFINQRKRNWHSNPSSSTSVKTKRKRAGGIHPKQ

SEQ ID NO: 19947 - protein, 621 aa, Eremothecium gossypii
MLRCIRRFSSRGAAASAVATGIPVGREAKRLMSKPLVTRLSVDGPIECPLSGMQLLNSPLFNKGSAFTQKERAAFGLEGLLPPQVNTLDEQVERAYKQLCYLKTPLAKNDFMTSMRMQNKVLFFELVRRHIRELVPIIYTPTEGDAIAAYSHRFRRPEGVFLDITEPDSIEERLASYGEDKDVDYVVVSDGEGILGIGDQGIGGIRIAISKLALMTLCGGIHPGRVMAVTLDVETNNKKLARDELYMGNRFARVRGKQYDEFLDKFIKALKKRFPSAVLHFEDFGVENARPLLDRYRTELPCFNDDIQGTGAVVMASFLAALKHTDRNLLDSKVLVYGAGSAGIGIADQIVNHMVSYGASVDEARSKIFTMDRRGLIMDSMRAGSTRAQQAYAKPDDEWEGVNTKSLVEVVSRIKPTCLIGCSTQAGAFNKAVVQEMHKHNERPIIFPLSNPTRLHEAVPEDLLEWTNYQALVATGSPFHPVNGYRISENNNCFSFPGIGLGAVLARATIISDKMISAAVDQLASLSPLKPGDSRPGLLPPLEVINDTSAKVATAVILQALEEGLARVEHEAVPNSTLGERVRVPRDFDKCLEWVKVQMWKPVYRPLLKVQHDPSVHTFQH

SEQ ID NO: 19948 - protein, 331 aa, Vibrio parahaemolyticus RIMD 2210633
MTIKVGINGFGRIGRFVFRAAQERADIEVVGINDLIDVEYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDFIGEVQTSVFDAKAGIALTDNFVKVVSWYDNEIGYSNKVLDLIAHISK

SEQ ID NO: 19949 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 19950 - protein, 501 aa, Novosphingobium aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 19951 - protein, 292 aa, Vibrio cholerae
MKGIILAGGSGTRLYPITRGVSKQLLPIYDKPMIYYPLSTLMLAGIRDVLIITTPEDNESFKRLLGDGRDFGIHLQYAIQPSPDGLAQAFLIGEEFIGNDSVCLVLGDNIFYGQSFSKTLRHAASREHGATVFGYQVKDPERFGVVEFDEQMRAISIEEKPSKPKSNYAVTGLYFYDNRVVELAKQVKPSVRGELEITTLNEMYLIDGSLNVELLGRGFAWLDTGTHESLHEASSFVETVQHIQGLKIACLEEIAWRNGWLTSEQLLECAKPMLKNDYGQYLERLVKEERHG

SEQ ID NO: 19952 - protein, 440 aa, Phyllophora truncata
  unsure (1)..(440): unsure at all Xaa locations
QPGVDPVEASAAVAGESSTATWTVVWTDLLTACDLYRAKAYKVDAVPNTSDQYFAYISYDIDLFEEGSIANLTASIIGNVFGFKALKALRLEDMRLPVAYLKTFQGPATGIIVERERMDKFGRPFLGATVKPKLGLSGKNYGRVVYEGLKGGLDFLKDDENINSQPFMRWKERYLYSMEGVNRAVAASGEVKGHYLNVTSATMEQMYERAEFAKQLGSIIIMVDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGVDVVLQFGGGTIGHPDGIQAGAIANRVALESXXXXXXXXXXXXAEGPQXXXDAAKTCGPLQTALDLWKDITFNYTSTDTADFVETPTANV

SEQ ID NO: 19953 - protein, 254 aa, Sinapis alba
MGRGRVELKRIENKINRQVTFAKRRNGLLKKAYELSVLCDAEVALIIFSNRGKLYEFCSSSSMIRTLERYQKCNYGPPEPNVPSREALAVELSSQQEYLKLKERYDALQRTQRNLLGEDLGPLSTKELELLERQLDSSLKQIRALRTQFMLDQLNDLQSKERMLNETNKTLRLRLADGYQMPLQLNPNQEDHHVDYGRHDQQQQQNSHHAFFQPLECEPILQMGYQGQQDHGMEAGPSENNYMLGWLPYDTNSI

SEQ ID NO: 19954 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQLNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADDTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 19955 - protein, 128 aa, Zea mays
  unsure (1)..(128): unsure at all Xaa locations
FTLDPTKFRSFSIHDTTVTTTNAGAPREERQXALTAGPCEPILLEDYHLIERVAHFARQRIPERAPHARGAFGKNWGERTHDFTXFTCAVPLRAPGVRTLVNVRFGTENHERWFFYTNQDRGGNGGDL

SEQ ID NO: 19956 - protein, 99 aa, Triticum aestivum
MAGKLYQLMARLHLAKGRASADVPKGHFAVYVGEQRKRFVIPTAYLRHPSFLVLLKRVEDEFGFDHRAGGGLTIPCSEGDFADIVGGCSSSSSPAVDYH

SEQ ID NO: 19957 - protein, 141 aa, Glycine max
MMQELSLECFSNDVVRLDLTPPSQTSPTSLSIDEEESSEAKIRRLISEHPVIIFSRSSCCMSHVMKRLLTTIGVVPTVIELDDHEVSSLPMALEEEFSGGVLPSPAVFIGRECVGGIESLVALHLSGHLVPKLVQVGALWV

SEQ ID NO: 19958 - protein, 456 aa, Escherichia coli CFT073
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGAWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 19959 - protein, 138 aa, Glycine max; identical to SEQ ID NO: 1236

SEQ ID NO: 19960 - protein, 472 aa, Kappaphycus alvarezii
ESGVIPYAKMGYWNPQYVVKDTDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGIDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 19961 - protein, 452 aa, Ostreococcus tauri
MAGTNTPVTAALGAAAANDGMDNVLSIILGGGAGTRLYPLTKKRAKPAVPLGANYRLIDIPVSNCINSDINKVYCLTQFNSASLNRHLAQAYNTNIGTHTRQGFVEVLAAQQSPVNKAWFQGTADAVRQYLWLFEESKCEEYLILSGDHLYRMDYRPFIMKHRETEAAITVAALPCDEKRASSFGLMKIDNTGRVIEFAEKPKGAELQAMKVDTTVLGLDADKAQEMPFIASMGIYVFDAKKMRECLLENFKEADDFGGEIIPMAAQMGLKVQAFLYEGYWEDIGTVDAFFHANLSCNDPNPAFNFHEMNAPIYTQSRFLPPSKVQDCEIERSTIGDGCFITKAKLKNVMVGLRSTVNANCDLEDTLVMGADYYETYDEAKTSALPGGVPIGIGAGTKIRKAIIDKNARIGENCQILNEAGVMDKDCENEGYIIRDGIIVVIKDAVIKPGTV

SEQ ID NO: 19962 - protein, 455 aa, Synechococcus sp. PCC 7942
MLPPGPSQLALLQTLRIITQPVSFLLSCADRYGDWFTLRVLGPQSPPVVFVSDPEAILAIFSSLADQLELGRIADVFRPLVGNESLIMQNGDRHRQQRQLLMPALQGERLFDYTPAMTAITQAAIAQWPLGQPLDLRRQMSQISLAVILQVVFGLTPGPRYRDLYQRLDQLLEAITDPLYSLQFFWPALQQDWGNWSPWGRFCRQREAIDALITAEIQEGRQSQQPRQDVLELLLAARDRDGNPLSDQELRDQLMTLLLLGHETTASALTWAVFWLLRHPDCLNRLQSELVAIGDNDRAIAKAPYLDAVCREALRLQPIALIAQPRRVASPLSLGGYDFASGTILVPCVLTAHRRAATYPNPDQFQPNRFLERRFSNGEFLPFGGGQRSCIGMALSLIEMKMVLATLLRQCQIAEVSQRPVRPARRGITFVPSQDFRIQVQQWHNPSAQTAIASV

SEQ ID NO: 19963 - protein, 283 aa, Salmonella enterica
IGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVSVIGGHSGVTILPLLSQIPGVSFSEQEAAELTKRIQNAGTEVVEAKAGGGSATLSMGQAAARFGLSLVRALQGEKGVVECAYVEGDGQYARFFSQPLLLGKNGVEERKSIGTLSAFEQRSLEG

SEQ ID NO: 19964 - protein, 241 aa, Zea perennis
SIRNNPVQNKLMNGEDPINNHAQTAGLGVRLATSSSSRDPSPSDEDMDGEVEILGFKMPTEERVRKRKESNRESARRSRYRKAAHLKELEDQVAQLKAENSCLLRRIAALNHKYNDANVDNRVLRADMETLRAKVKMGEDSLKRVIEMSSSVPSSMPISAPTPSSDAPVPVPPPIRDSIVGYFSAPAADDDASVGNGFLRLQAQEPAAMIVGGTLSATEMNRVAAATHCAGAMELIQTAMG

SEQ ID NO: 19965 - protein, 197 aa, Pseudomonas putida
MLLMIDNYDSFTYNVVQYLGELGAEVKVIRNDEMTIAQIEALNPERIVVSPGPCTPSEAGVSIEAILHFAGKLPILGVCLGHQSIGQAFGGDVVRARQVMHGKTSPVHHRDLGVFTGLNNPLTVTRYHSLVVKRETLPDCLEVTAWTAHEDGSVDEIMGLRHKTLNIEGVQFHPESILTEQGHELFANFLKQTGGRR

SEQ ID NO: 19966 - protein, 348 aa, Staphylococcus aureus subsp. aureus Mu50
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 19967 - protein, 364 aa, Zea mays
RLTWSTPRLFARDSPPRIGGSAVTGSSISPAIVFCSRLRLLAEHALLPGGAGVPHRPLVAFPSRRAMDFCSHLRLAAVLALLTGCASAASRGAGSFDPSRVVQLSWRPRAFLHKGFLLDAECDHLIALAKDKLEKSMVADNKSGKSVQSEVRTSSGMFLEKKQDEVVTRIEERISAWTFLPPENGEAIQILHYQNGEKYEPHYDYFHDKNNQALGGHRIATVLMYLSNVEKGGETIFPNAEGKLLQPKDDTWSDCARNGYAVKPVKGDALLFFSLHPDSTTDSDSLHGSCPVIEGQKWSATKWIHVRSFDLTVKQPGPSDGCEDDNVLCPQWAAVGECAKNPNYMVGTKEAPGFCRKSCKVCAE

SEQ ID NO: 19968 - protein, 252 aa, Buchnera aphidicola str. Bp (Baizongia pistaciae)
MKKKIIIANWKLNGNIQLLQTLLKPLVNFYIRHKNKSSIKLVIMPPYVYLYPMKSIISHSSILLGSQNVDINLIGAFTGEVSINMLKDVGVSYVLVGHSERRQYHRENDVIIAKKFKIVKDSHLIPVLCIGETEHEYLSCKTEKICKFQIDAIFDLLGPSGFNNSVIAYEPKWAIGTNTIPSINFIQKILMFIQNYIFNKQNSTIKLFSLQYGGSVNEHNIIELYDVKNIDGFLVGSASLSLDFFKKLLNNC

SEQ ID NO: 19969 - protein, 176 aa, Schizosaccharomyces pombe
DLNKFYDYGNTSWILACTPLCLIMVPGVAFFYSGLARRKNTLALIMLSMLGLCVSFFQWYFWGYSLAFSQTGTSGYIGNLRHFAFIRTLADYSPGSNNIPELVFANFQGMFAAITVALFTGAAAERGRIGPMLIITFVWLTVVYCPIACWIWNPNGWAFKFGVYDFAGGGPVEVGS

SEQ ID NO: 19970 - protein, 415 aa, Eremothecium gossypii
MGLCASKDKGSATHAEKRRQDRHGASQKVETGAKRVDYGAEVKPETSPSHSTSGATAGGRKRSVVSGTSQQTTAVAGPGSMGQPSASNRALKVLLLGSGESGKSTVLQQLKILHQNGFTQEELLDFKPFIIDNIVETGKDLLNARAKFNVLLEPDCGLTENDLQQVLEYSRPAGSTPLLPRGLAGILSRIWQLPSTKELLTGPERSSFYLMDNAGYFFKSLDRISQPDYVPTVADVLRTRKKTSGIFDTTIEMDADLKLHIYDVGGQRSERKKWIRCFDNVTLIIFCVSLSEYDQTLIEDKTQNRLQESLILFDSVVNSRWFTRTSVVLFLNKIDAFAEKLQTVPLEKYFPDYTGGQDINRAAKYILWRFVQLNRANLNIYPHVTQATDTSNIRLVFAAIKETILENTLRDSGVL

SEQ ID NO: 19971 - protein, 378 aa, Eremothecium gossypii
MSGEKADKTVESAAEEAVAATPVLATKGGRETSDRILYVGNLDKTINEATLKQYFQVGGPIANVKVLVDKNNEEANYAFVEYRQPRDANVAFQTLDGKQIENNVIKINWAFQSQQVSSDDTFNLFVGDLNVDVDDETLSSTFKEFPTFIQAHVMWDMQSGRSRGYGFVSFGEQEEAQKAMDAKQGFNLNGRAIRVNWAAKRESQHAARPRSNRGGFRGGSGHQPFRGMPQGPHLGGAAPAGPMQLQGPPVPSPVNPQAVEAMIRRAPQRVTTAYIGNIPHFAQEPDLIPLLQNFGFIIDFKHYAEKGCCFIKYDTHDQAALCIVALANFPFQGRTLRTGWGKEKPSFVPNGAVPHAAAPAPVQPASDAVPAQDQEHQQ

SEQ ID NO: 19972 - protein, 446 aa, Corynebacterium glutamicum ATCC 13032
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 19973 - protein, 179 aa, Daucus carota
MERADQQARGFQGYRKIHQQQQLPASGTASTGTDNNPAAGDQDCLVREQDRFMPIANVIRLMRKSIPSHAKISDDAKELVQESVSEFISFVTSEANYRCQKEQRKTITAEDVLWAMSSLGFDDYVEPLTFYLDRFREADGGERTALRGEPLVKKSGEHGHRGFLQHLHHGTIWGRIMRF

SEQ ID NO: 19974 - protein, 547 aa, Zea mays
  unsure (1)..(547): unsure at all Xaa locations
MAMLVPDLSFSASISSVKLPRYGASKSETFFVKKPPTFRAEARPAESGKYGTNNGRATKMVPTTEFRRTSGVINGTPKVAVNGTSLVKSSKTSLVKTQKQVRPKDDPFQEELKVLPSDEGFSWAKDNYNSVQRSIDIWSFVLSLRVRVLFDNAKWAYPGGFSEEKQKVRRRKTASWLREQVLQLGPTFIKLGQLSSTRSDLFPREFVDELAKLQDRVPAFSPEKAKAFIEKEMGCSIDVVYKEFEERPIAAASLGQVHRAMLHNGERVAVKVQRPGLKKLFDIDLRNLKLVAEYLRARHSLTFGGPSRDWIGIYEECSKILYEEIDYINEGKNADKFRRDFRNIKWVRVPLIMWDYTTEKVLTLEYAPGIKINNLDVLDNRGYSRSLIASRAIESYLIQILKTGFFHADPHPRNLAGDMDGQKIFNANRTRSAVCRCPCYCWGPLFYSVFVNASHKVRKALMDANSPQPVCTLXWSTRSCQFFLDNPLSQSPDQQQTLAAIGEDLVAHAREPSNWLQTCGEKGVGSSRECTYRCTYWSHHWSLNNSP

SEQ ID NO: 19975 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLIMMILCSVASGLSFGNEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPRQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANLGPNATTFIVPAEIFPARLRSTCHGISAAAGKAGAIIGAFGFLYAAQNQDKAKVDAGYPPGIGVKNSLIVLGVLNFIGMLFTFLVPEPKGKSLEELSGEAEVSHDEK

SEQ ID NO: 19976 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 19977 - protein, 458 aa, Listeria monocytogenes EGD-e
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 19978 - protein, 360 aa, Gypsophila elegans
MVIATKVAPSRVETLASSGIECIPKEYVRPEEELTSIGDVFEEEKKDGGPQVPTMDLKDIASEDPEVRDKAIQELKKAAMEWGVMHIVNHGISEELITRVKVAGETFFEFPIEEKEKYANDQDSGNVQGYGSKLANNASGQLEWEDYFFHLAFPEAKRDMSIWPKAPADYIPAVSDYSKELRGLATRILSALSVGLGLEEGRLEKEVGGLEDLNLQMKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPDLVSDSDPARYPPRTFAQHIQHKLFRKAQDVQSPVTN

SEQ ID NO: 19979 - protein, 191 aa, Zea mays
SKLTSKKKKKKKNKKKKKKKKKKKKEHNRLAFPSPPARLSLLSDSLSRSRVHLAAASKRDQRAPLGDGGAAAAAASNNLGGSFGEMLIDFVPDGAGLSLAESGGFVKAPGGAPANVACAIAKLGGSSAFVGKFGDDEFGHMLGNILKQNNGNAEGGLFDKHARTALAFGTLKHDGEREFMFYRNPSADMLL

SEQ ID NO: 19980 - protein, 296 aa, Aneurinibacillus thermoaerophilus
MKGIILSGGSGTRLYPLTKVVSKQLLPVYDKPMVYYPLSVLMLAGIKDILIISTPEDTPRFEQLLGGGSELGISLSYAVQSSPDGLAQAFIIGEEFIGDDNVALVLGDNIFYGHGFTELLQRAANRKSGATIFGYNVKDPQRFGVVEFDEKGKVISIEEKPEEPKSSYAVTGLYFYDNRVVDIAKNITPSARGELEITDVNKAYLELGELHVELLGRGFAWLDTGTHESLLQASQFIETIEKRQSLKVACLEEIAYRMGYISREQLIKLAEPLMKNEYGQYLMNLAHRSKDLVTVE

SEQ ID NO: 19981 - protein, 472 aa, Shigella flexneri 2a str. 2457T
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 19982 - protein, 261 aa, Psidium guajava
NWGFFELVNHGIPPEMMDTIERMTKGHYKKCMEQRFRELVVSKGLEYVQKEVHDLDWESTFHLKHLPESNISQISDLDDDYRKVMKEFAVKLEKLAEQLLDLLCENLGLEKGYLKKAFYGSNGPTFGTKVSNYPPCPKPDLIKGLRAHTDAGGIILLFQDDKVSGLQLLKDGQWVDVPPMHHSIVVNLGDQLEVITNGKYKSVLHRVVAQTDGNRMSIASFYNPSTDAVIYPAPALVEREEEEAGKGTYPKFVFEDYMKLR

SEQ ID NO: 19983 - protein, 138 aa, Schizosaccharomyces pombe
MGFPLEKSEDEWKKELGPEKYRIMRQKGTEHPGAGRFTHQFPKQGVFVCAACKELLYKASTKFESHCGWPAFFDNLPGKVKRIEDNSYGMHRVEAVCANCGGHLGHIFKGEGYSNPTDERHCINSASLEFHNEATNDN

SEQ ID NO: 19984 - protein, 158 aa, Zea mays
  unsure (1)..(158): unsure at all Xaa locations
VRPFPLFFLQPSKRPAKQGTQIESSPCHARKAPAAHDGNGNARAAAAAAPKGCVTVRVGLEGEEQRRFAVPLGHLKHPLFGALLEEAEREYGFRHQGALAIPCRVARFVQLERLIGRDLHGACAHHLVDLDGXAAXPPAQHQHQHHLHLPRFVGCFRA

SEQ ID NO: 19985 - protein, 405 aa, Pseudomonas aeruginosa PAO1
MSGCCEQPGLMPVETALERLLELAAQTPIDTCEQVPLEQAGGRVLAVDLLAGLDLPPWPNSAMDGYALRLADWNGEPLPVSQKIFAGQAPKPLQAGTCARIFTGAPLPEGADLVEMQENAEALDDGRVRFTQPLRVGQHVRPRGQEIRQGDLVLPAGTRLRSIELGLAASLGYAALEVRRKPRVALLSTGDELVEAGQPLQAGQIYNSNRPLLKDWLQRLGCDVLDAGILPDDLARTRERLAGLAGVDLILSTGGVSVGEADFLGMALREAGELTLWKLAIKPGKPLTVGQFQGIPVIGLPGNPASTLVTFALLARPYLLRRLGVAQVAPLRVEVPAGFAWTKAGQRREYLRGRLEQGRAVLYPNQSSGVLRSASWAEGLVEVREGRTLVEGEGVAFIPLSELLD

SEQ ID NO: 19986 - protein, 451 aa, Novosphingobium aromaticivorans
MVGRVAEADETDMDAAVAAARDAFDHGPWPTTPPAERIAAFRRMVAHLETRVPELAKAWTAQMGGLASFAGPMHGGSVMALGQIAGFAEKFEFVERRPSMAADTALIAYEPVGVVAAIAPWNGPFGIMANKVAYALLTGCTVIMKPSPETPLEAYIIAEAAEAAGIPAGVVNLVTGHREASDHLVCNEGVDKVSFTGSTVAGKRIASVCGSRMARCTLELGGKSAAIVRDDFPIDAAAKMLAGTITMMSGQVCAMLSRVIVPRRRHDELAEAIAAEMKKVRIGNSDDPETQLGPVAMKRQLERIEMYIEEGRKTADLVTGGGRPAHLNRGYFIEPTLFANVRNESRIAQEEIFGPVLSLIPVEDEEDAIRTANASAYGLNGSVLTNDAEAAYRIARRVRTGGFGQNGLRMDFGLPFGGFKQSGIGREGGPEGLFPYLEMKTILIDGMPSAL

SEQ ID NO: 19987 - protein, 309 aa, Salmonella typhimurium LT2
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGQQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 19988 - protein, 57 aa, Arabidopsis thaliana
MAFDGCCPDCKLPGDDCPLIWGACNHAFHLHCILKWVNSQTSQAHCPMCRREWQFKE

SEQ ID NO: 19989 - protein, 364 aa, Vibrio vulnificus CMCP6
MNIQALPMHRFLDYEGNVQSPLPSWASEERLVQFYRDMLITRAYDNKAVALQRTGKLGTYPSHLGSEAFGVGIGHALKPSDVFIPYYRDMPAMWVRGIGMEKNLQYWGGDERGSDFCPEESHLRCSDLPFCVPIATQCTHAVGVASALKIQGNHDAALVTCGDGATSKGDFLESINCAGVWHLPLVFVVNNNQWAISVPRQLQCAADLLSEKAKGAGIPGITVDGNDVVAVYDAVNNALDRARKGKGATLIEAISYRLSDHTTADDASRYRSADELKQAWQYEPIKRLQAYLTAQGLWNEELEQQWLAHCKQQVEQAVAHYLSLPPQAPESAFDYLYASLPVELHAQRDMLINKAMRMQGGKHG

SEQ ID NO: 19990 - protein, 165 aa, Zea mays
GRVGGRVGGRVGGIRILDEAHQCIVELQSPDYYPEIVKEAVNLALDKGTNFVDPLVRLLEHLYTKKIFKTQDLESGCLLYGTLLDDIGIDLPKAPTQFGEIIARLTLLGALRFEVMEEILKKMEDTMYRKAVFDAVKKTLEANPSGQTILGSHAAVIDACNSLLE

SEQ ID NO: 19991 - protein, 452 aa, Staphylococcus epidermidis ATCC 12228
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKESR

SEQ ID NO: 19992 - protein, 422 aa, Grateloupia carnosa
DTDVLALFRVTPQPGVDPVEASAAVAGESSTATWTVVWTDLLTACDLYRAKAYKVDAVPNSSEQYFAYISYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEAVNRSIAATGEVKGHYMNVTAATMEDMYERAEFAKQLGTVIIMIDLVIGYTAIQTMGIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALESMVMARNEGRDYVAEGPQILQDAAKTGPDN

SEQ ID NO: 19993 - protein, 185 aa, Glycine max
SYVGPPPIAALEAGGDKSQHSSIPVLENVSHGQLQALSAVSADFFVIAPPSVLKGSGVVKRFGSRVLVVPMHSDWFSPASVHRLERQAVPHFFSGKSPDHTPEKYMECRNYIVARYMEDPGKRITVSSCQGLSVGVGNEDLTRIVRFLDHWGIINYCAPGPSHENSDNETYLKEDTSGAICVPSA

SEQ ID NO: 19994 - protein, 339 aa, Talaromyces emersonii
MFATRQAFNLFQKRAFSASARQSSKVAILGAAGGIGQPLSLLMKLNPRVTELALYDIRGGPGVAADLSHINTNSTVTGYQPTPEGLRDALKGSEIVLIPAGVPRKRGMTRDDLFNTNASIVRDLAKAAADACPNANILVISNPVNSTVPIVAEVFKSKGVYNPKRLFGVTTLDVVRASRFISEVKNTDPANEEVTVVGGHSGVTIVPLISQSNHPDIEGETRDKLVNRIQFGGDEGVKAKDGAGSAALSMAFAGARSPSLCSSGQGVKGVVEPSFVDSPLYKDQGIDFFASRVELGPNGAEKVLPVGKVSPYEEKLLEAAFADLKKNIQKGIDFVKNNP

SEQ ID NO: 19995 - protein, 106 aa, Zea mays
  unsure (1)..(106): unsure at all Xaa locations
GKTGXTHEASDLLSFTPGPTPVKTTPKPIRAEPVVVLVPDKQASLPKGNIVELQKKTIALLEEYFDIRILDEAYQCIVDLQSSDYYPKIVKKAVNFALYKGTNFVD

SEQ ID NO: 19996 - protein, 707 aa, Ustilago maydis
MSQNIVSALHPPLDSSTWSPYQTFLTVTLTLLHHLTSRHPVASRCGRAAPPLLAVHKQRRMLALPVSPPGRSLPPRWCCCRRWSFQASLDRDCATKASVASAASGVLGTRKRAALGDLTNANRTRSAMAGNDDKGKAALKDAIKPRATTSASTSSRSAVGTAASATTTGTGAARRVVRTRPTTASSTTASTTVTDAASDRPFRASRRVAGTTASTASGIPSATSRPTSTTTATSAVTAARKASMVRASSAGSQTDVRRDVSNTSAVTTNTTAPITAASRSSKVQLNEVHDTDDKMEAPQAKRLKTEQTNKPAKDEGWEDLDAEDADDPLMVAEYVNDIFEYMKELEIINMPNGDYMANQKEINWDVRAILIDWLVDVHAKFRLLPETLYLAVNIIDRFLSRRTISLSKLQLVGVTAMCIASKYEEVMCPSIQNFCHLADGGYTDVEILRAERYMLKVLDFSMSYANPMNFLRRISKADNYDIQTRTVAKYFMEISLLDYRLMEHPPSLIAAASVWLAREVLERGEWTPTLVHYSTYSEQELLGTAEIMLDYCLRPIAHQFFHKKYAHKKFMRASTYVIEWAHKAFPEGVVGVDEQQDLNVLRIDLYERNEIERPEMSPVSSSRATSPVSMHGQAHFEVEPSQNVDGDDTVSYAHDDDHEEEDDLVDDAQEIEGDVQLLDDVKAAAQRQDTRQVLRDVTNAYEATETF

SEQ ID NO: 19997 - protein, 397 aa, Zymomonas mobilis
MKPKLPLNRRQNPVRIMFLRLLSEQPQVKRRPLSRPMISQQQWPNWMLPRRLWQPMMINMLSVLSVMIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITQKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQVPSMSIRAFPSLLARKPHQVKSLKKTWISQAI

SEQ ID NO: 19998 - protein, 200 aa, Oryza sativa
MGMEARRKMRFAMVCSSNMNRSMEAHSLLGRAGLDVASYGTGTHVKLPGPSLHEPNVYDFGTPYNVIYDDLRRKDPDLYKRNGLLPMLKRNTSVKLAPQWWPVPPGGGRFAVIFSFEERVFDLIVDDMHNREQRMLKNALIINMDVKDNHEEAGVGAKLALDLCQKLEGADEDWEEIIDDLIITFEKQHKRKLTYNMAFY

SEQ ID NO: 19999 - protein, 358 aa, Vibrio vulnificus CMCP6
MSKIFDFVKPGVISGDDVQKVFEVAKENNFALPAVNVVNTDSINGVLEAASKVKAPVVVQFSNGGAAFFAGKGVKLEGQGAQILGAIAGAKYVHAVAEAYGVPVILHTDHAAKKLLPWIDGLLDAGEEFFAQTGKPLFSSHMIDLSEESLEENIEICAKYLARMEKMGMTLEFELGCTGGEEDGVDNSHMDQSELYTSPEDVAYAYEKLIPISHRFTIAASFGNVHGVYQAGNVVLTPTILRDSQAYCSEKFGIAPNALNFVFHGGSGSSEAEIKESISYGVIKMNIDTDTQWATWDGIRQYEAKNHDYLQGQIGNPTGESAPNKKYYDPRVWLRAGQESMVARLEKAFADLNAVDVL

SEQ ID NO: 20000 - protein, 379 aa, Marah macrocarpus
MAITCMMATESSPAEEVKREHQVAFGGAGESSVPENFIWPDEFKATADAPELHVPHIDLKKVLSGDEKDVEEATRLVDEACRKHGFFVVVNHGVDKELMNKVHECMNEFFTLPLDVKQKAHRKVGENFGYANSFIGRFSTKLPWKETFSLRYLAHENSSTARDYVSQVLGPEFSHHGEVYQECGKALSDLSLRIVELLGLSLGISRETFRKFYEDNDSIMRMNYYPRCEKPELTLGTGPHCDPTSITILHQDDVSGLQVYVDDQWHSIPPTEDSFVVNVGDTFMSLTNGVYKSCFHRAVVNCKEARKSMAFFLCPAVEKVVRAPEELVEKYPPRKFPDYTWPMLLEMTQKYYRADSNTFNAFTTWIQQQNLDSTASPAV

SEQ ID NO: 20001 - protein, 394 aa, Rhodobacter sphaeroides
MISVEEALARALALAAPLPVERVALGEARGRVMARPALATRDQPPFDASAMDGYALIGDPPAGATFPVVGEAAAGHGYEGALRPGEAVRIFTGAPVPEGATRVVLQEDVTAEGGTIRLNAAATGGTHIRPRGQDFRTGDSLSPRRLRPNDLALLAAMNIPEVTVTRRPSVALIATGDELVMPGEVPRPDQIVASNSFALKALVEAEGAEARLLPIARDTEDELRTVLDLASDADLIVTIGGASVGDHDLVGKVAAGMGLERAFYKIAMRPGKPLMAGRLRGVPMLGLPGNPVSSIVCAHLFLLPMLRAMLGLPPAPAPLLRAELAVALPANPTRAHYMRARLTRQDGLPRIEPFSSQDSALLRLLAEADALLVRPVDDGPRAVGDLVDYISLNS

SEQ ID NO: 20002 - protein, 319 aa, Wigglesworthia glossinidia endosymbiont of Glossina brevipalpis
MNQLDYIKKFTNVVIDSGNIKYIKKYSPKDVTTNPSLILRESKSKHYYPLLMDAISYAKKKGGNLNSYIINANDKLLVNIGREILKIIDGRISIEIDVRLSFSYLDLIIRAKKIISLYNSYGIENNRILIKIAATWEGIQAAKFLEKSGINCNLTLIFSLVQAIACAESNVYLISPFVGRVNDWYIKNFKLNKNSKIDPGVKLVYKIFYFYQKYGYKTFVMGASFRNIDQIISIIGCDAITISPDFVNKLNNLKLKKIKNFIRVNLESKIKKNKLLEKEFRWKFNQNFMAVEKLSEGIRLFLRDQKKIDSFFLKKFKSG

SEQ ID NO: 20003 - protein, 132 aa, Zea mays
  unsure (1)..(132): unsure at all Xaa locations
PVRKLEALIAAANIIYIFHILHTPPGENALFDVLLITPIFTXNKFKTXGPASAGAGSETGPSLFQLIFYPNLYPELALALQLSMXEERSRQQAIANKAAXDTFNTEHNNVPSSNSDSVMAEXEPASNAAAVD

SEQ ID NO: 20004 - protein, 110 aa, Triticum aestivum
GPLCCWRLLGTVGAVWFIHKASQVGTVTEAIEAVKQAKDAHWGVMVSHRSGDTDDSFIADLAVGAAAGQIKAGAPCRGECLTKYNQLLRIEEEFGSEGVYAGENWRTTAS

SEQ ID NO: 20005 - protein, 382 aa, Escherichia coli K12
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 20006 - protein, 189 aa, Oryza sativa
NSCSPFFPSENGEDIQVLRYKHGEKYERHYDYFSDNVNTLRGGHRIATVLMYLTDVAEGGETVFPLAEVISLRGTNNEDSTLSECAKKGVAVKPRKGDALLFFNLSPDASKDSLSLHAGCPVIKGEKWSATKWIRVASFDKVYHTQGNCTDDNESCEKWAALGECIKNPEYMIGTAALPGYCRKSCNIC

SEQ ID NO: 20007 - protein, 282 aa, Streptococcus pyogenes SSI-1
MGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADIVVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVVPVVEKVPVDTAPEVFDEMERGLIQGRKVLDFIS

SEQ ID NO: 20008 - protein, 382 aa, Escherichia coli O157:H7
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESDQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAENAAKRGHLTASTVIQYRGAIIPREAMPA

SEQ ID NO: 20009 - protein, 585 aa, Zea mays
MDLLDARHRHTPDLSSSQDAASNMGLPLAGAAYQPYVSELLSFSIERLHKEPELLRVDAERVRRQMQEVAVENYAAFIAASEALSFVRAQLESFDGHLEAMIEEIPNLTSGCTEFVESAQQILEERKLNQTLLANHTTLLDLLEIPQLMDTCIRNGNYDEALDLEAFVSKIWKLHPDLPVVQGLATEVKKTVQSLVSQLLQKLRSNIQLPECLRIVAHLRRIGVFSESELRLQFLRCREAWLSGILEDLDQRNVYDYLKGMVTCHRVHLFDVVNQYRAIFNNDKSGNDENYDGGLLFSWAMQQVSNHLTTLQVMLPNITEGGSLSNILEQCMYCAMGLGLVGLDFRGLLPPIFENAVLNLFSKNMSTAVENFQVILDSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQAFIEVVHPYCAACFGRCYPNGATLISECQGTLDAVRQLLTIPARSNSSSIERKQSGAIERKQSVESSGTAVTDNELSADGPGLEINDAATTTTPPVEDDVSTHPPGSK

SEQ ID NO: 20010 - protein, 306 aa, GIBBERELLA ZEAE PH-1
MDRNPIPRQARRPKMTRSARVPGKRPRSEFETHHVQENDPAPTIPSSPSVRRATRLIKTKECLACGEDFPQSSMIFAPCSHLFCKPCADNLVSLAMRDEAYFPARCCDTMIPVTLSNGFSNEVVIQYNAKAVEFAIPSLGRVYCSSEICATFIPPTQIDSGIGHCKRCLTDTCIACKAKAHEGVCGHKDEDVQGVLRLAQGTGWKRCSKCGHVIEKSMGCDHMVCLCGHRFCYACGKDAGKCACDEVPVDVPMPPHAANPPCNNHRWGRILQPENCEDCGKAVQGYNIFICRGCAHIACLACRRRL

SEQ ID NO: 20011 - protein, 296 aa, Klebsiella pneumoniae
MANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKLLA

SEQ ID NO: 20012 - protein, 522 aa, Zea mays
NSGGKCDFDLAATFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADIYETEEEASKLLLAGKVPIGIGRNTKIRNCIIDMNARIGKNVVITNSKGIQEADHPEEGVI

SEQ ID NO: 20013 - protein, 143 aa, Glycine max
  unsure (1)..(143): unsure at all Xaa locations
DDATNFWDYASQNPESVHQFMVLFGDRGIPDGYRKMHGYIGHTHKLLNKNGDWVYMQLHFKSKQGTGFITQEDSFNYGPDYSTKDLYQAIDKGDFPGWDVCVQTMTAKEAEELWEKQKINVFDLTHVWXQGQFPLRKVGEFFL

SEQ ID NO: 20014 - protein, 422 aa, Halobacterium sp. NRC-1
MSYDKIEVPEGGAKVSYDEAADELDVPDTPIIPIIHGDGIGKDVGPIAQDVLSAAAEATGHDIEWMEVYAGESAREMYDENLPEETVEAIREHRVAIKGPLTTPVGAGFRSLNVALRQTLDLYANVRPTYYLDGVPSPMKAPEEMDMVTFRENTEDVYAGIEWEAGTDEAEQVRSFVEDEMDFDDVMHDGDIGIGLKPISEKGSKRLVREAIDYAIENDRDTVTLVHKGNIMKFTEGQFGDWGMEVAEEEYPDDEVFAAPDSLWEEQDEVDIPEDAVMVEERLADAMLQWMQLRTDEFDVLAMPNLNGDYLSDAAGAQIGGLGIAPGANFGAGRCLAEPVHGSAPKRAGQDKANPTALILSGRLLFEYIGWDDASTLVRDAVEDTIESGTVTYDLARQRDDAEEVSSTTYAEAVIDRIEDLA

SEQ ID NO: 20015 - protein, 460 aa, Mazzaella affinis
  unsure (1)..(460): unsure at all Xaa locations
WDPDYVVKDTDVLALFRVSPQPGVDPVEASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGVICERERMDKFGRPFLGATVKPKLGLSGKNYGRVVYEGLKGGLDFLKDDENINSQPFMRWKERYLYSMEGVNRAIAAAGETKGHYLNVTAATMEDMXXXXXXXXXXXXXXVMIDLVIGYSAIQSMAIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGDDVVLQFGGGTIGHPDGIQAGATANRVALESMVIARNEGRDYVAEGPQILQDAAKTCGPLQTALDLWKDISFNYTSTDTADFVETPTANV

SEQ ID NO: 20016 - protein, 131 aa, Zea mays
  unsure (1)..(131): unsure at all Xaa locations
QIEKAQEIAKAELAAAVAKEKASQIEQIAEANLNDIDALCMAFYARSEXTRQSHSVHKLALGTLALEHALSSGSPIRSEVELLRKSVEGIDKDSLLELALSSLPEDVLDYGSDTMMGLKQKFNSLKETIRH

SEQ ID NO: 20017 - protein, 299 aa, Streptococcus agalactiae 2603V/R
MKVRKAVIPAAGLGTRFLPATKALAKEMLPIVDKPTIQFIVEEALKSGIEDILVVTGKSKRSIEDHFDSNFELEYNLKEKGKNELLKLVDETTGIRLHFIRQSHPRGLGDAVLQAKAFVGNEPFVVMLGDDLMDITNNKVIPLTKQLINDFEATHASTIAVMEVPHEDVSAYGVIAPQGEGVNGLYSVNTFVEKPSPEEAPSNLAIIGRYLLTPEIFNILETQKPGAGNEIQLTDAIDTLNKTQRVFARKFTGDRYDVGDKFGFMKTSIDYALQHPQVKDDLKKYIIDLGKSLEKTSKK

SEQ ID NO: 20018 - protein, 673 aa, Oceanobacillus iheyensis HTE831
MSNQEQNKKNQQLDQFRVNDKDKSLTTNQGLKMNEDEFSLKAGERGPSLLEDFHLREKITHFDHERIPERVVHARGFAAHGEFEVYESLAPYTKANFLGEAGKKTPVFVRFSTVAGSRGSGDMARDVRGFATKFYTDEGNYDLVGNNIPVFFIQDGIKFPDLIHAVKPEPHNEIPQAQSAHDTFWDFVANNQETAHMIMWHLSDRAIPRSFRMMEGFGVHTFRFVNEEGQAFFVKFHWKPVLGVHSVIWDEALKLNGNDPDFQRRDLYDAIENGQYPEYELGLQIIKEEDEFNFDFDVLDPTKIWPEEDVPVKIVGKMTLNQNIDNYFAETEQVAFHPGHVVPGIDFTNDPLLQARLFSYTDTQLIRLGGPNFHEIPINRPVCPFHNNQRDGYGRQTINSGQVSYHKNSLADNTPTPVSEENGGYKHYQEKVEGKKVRARSISFEDHFTQAALFWNSMSDVEKNHIIDAFSFELGKCKEVAIREQVLDMFSNVSHDLVTGIAENLGLAIPKKKEIDYTKSSPALSQANTKKKADTRKVGIIVADGFDEELFSHIKALNEANINPEIISDHQGSISSKEGNKIPVHHTFKTADSVLFDSILIASKEGTKPLFTKEAPNFVKEAYMHYKPISALQDGASVLHDLGLTDEKGVVTNNASQFVEAVAEARFWNRDGK

SEQ ID NO: 20019 - protein, 204 aa, Vibrio mimicus
AGSDLALYDIAPVTPGVAADLSHIPTPVTIKGYAGEDPTPALEGADVVLVSAGVARKPGMDRADLFNVNAGIVKALAETIAVVCPKACVGIITNPVNTTVPIAAEVLKKAGVYDKRKLFGVTTLDVIRSETFVAALKDKDPGQVRVPVIGGHSGVTILPLLSQVEGVTFTDEEVAVLTKRIQNAGTEVVEAKRGGGSATLSMGQ

SEQ ID NO: 20020 - protein, 550 aa, Oryza sativa (japonica cultivar-group); identical to SEQ ID NO: 4571

SEQ ID NO: 20021 - protein, 456 aa, Polyangium cellulosum
MISISKSKQKLLPPGPRSPMALQTLQWLKNPVPFLEACGARYGEMFTLKLPTQWPVVVVQHPEAVKEVFALDSNAGHAGEANNILKPFLGKYSLLVLDGEEHMRQRKMMMPAFHGERMEAYGHAMIDAAHASIDAWPVGSPFGVHAPMQAITLQVILRTVVGMTDGPLLAELEALYPQVIDAASAPAMHFELFRKDLGPWSPWGKFKRRSARGKEIMIHEIRRAREKGTAGRTDVLAMIIDAKDENGELLTEDEIHGELMTLLVAGHETTATALCWALRWLLRDAALTRRVAEEAAEVADDPVKIAKSELLDRVVKEALRLQPIGPVVARVLKQPLTIQGRELPADVMVAPCVQLLHHRPSLYPEPTRFDPDRYATFTPKPWEFIPFGGGLRKCIGAAFSMYEMKMVLATAFSRLSMELATDDIKIIRRGVTLAPSGGLPLVIRKKSPRATKPIAA

SEQ ID NO: 20022 - protein, 216 aa, Bacteroides thetaiotaomicron VPI-5482
MKPIISPSILSADFGYLARDIEMINRSEAEWVHIDIMDGVFVPNISFGFPVLKYVAKLTDKPLDVHLMIVNPEKFIPEVKALGAHTMNVHYEACTHLHRVIQQIKEAGMQPAVTINPATPVALLQDIIQDVYMVLIMSVNPGFGGQKFIEHSVEKVRELRALIERAGSKALIEVDGGVNLETGARLVEAGADVLVAGNAVFGAPDPEEMIRQLHKL

SEQ ID NO: 20023 - protein, 317 aa, Arabidopsis thaliana
MAGIRLLPEEPETTPQQQARAAAAVTTTTTDSLASDDDRSIAADSWSIKSEYGSTLDDDQRHADAAEALSSANFRVSSDYSSDKEEPDADGGGQSMLGLQSYWDAAYSDELTNFREHGHAGEVWFGDDVMEIVTSWTKDLCVEISQRNMSVSENDVTTEVNDQADKYLSSWNVLDLGTGNGLLLHQLAKEGFSDLTGTDYSDGAVELAQHLSQRDGFPNIRFMVDDILDTKLEQQFKLVMDKGTLDAIGLHPDGPVKRVMYWDSVSKLVAPGGILVITSCNHTKDELVEEVENFNIRKSNLCRGDGNDANNVLSLWL

SEQ ID NO: 20024 - protein, 412 aa, Ceramium deslongchampsii
SAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIVMIDLVIGYTAIQSMGIWARKNDMILHLHRAGNSTYSRQKIHGMNFRVICKWMRMAGVDHIHAGTVVGKLEGDPLMIRGFYNTLLQSYLKVDLPQGIFFEQDWAALRKVTPVASGGIHCGQMHQLLDYLGNDVVLQFGGGTIGHPDGIQAGATANRVALESMVIARNEGRDYVPEGPQILRDAAKTCGPLQTALDLWKDIT

SEQ ID NO: 20025 - protein, 58 aa, Glycine max
  unsure (1)..(58): unsure at all Xaa locations
SCPPRIAEFKPVPDVDHLQDLLAFQHQGPXXLAFFGTRNLGFXHQELIEILSFAMVTT

SEQ ID NO: 20026 - protein, 200 aa, Glycine max; identical to SEQ ID NO: 1856

SEQ ID NO: 20027 - protein, 388 aa, Thermobifida fusca
MASRAASTGSHSAPISSSSGRRLATKAASSASTRGRTKATGDKCEELIRAGYRLFRRPSSPRHTQTPPIWSITVGDMLGSPTPRPAPRPRRISELLARKEPTFSFEFFPPKTPEGERMLWRAIREIEALRPSFVSVTYGAGGSTRDRTVNVTEKIATNTTLLPVAHITAVNHSVRELRHLIGRFAAAGVCNMLALRGDPPGDPLGEWVKHPEGLTHAEELVRLIKESGDFCVGVAAFPYKHPRSPDVETDTDFFVRKCRAGADYAITQMFFEAEDYLRLRDRVAARGCDVPIIPEIMPVTKFSTIARSEQLSGAPFPRRLAEEFERVADDPEAVRALGIEHATRLCERLLAEGAPGIHFITFNRSTATREVYHRLVGATQPAAVAALP

SEQ ID NO: 20028 - protein, 485 aa, Agrobacterium tumefaciens str. C58 (Cereon)
MHSGKTAPAEREVFVEEDLGYHKALKPRQIQMIAIGGAIGTGLFLGAGGRLAQAGPALVFVYALCGFFAFLVLRALGELIMHRPSSGSFVSYAREFYGEKMAFAAGWMYWLNWAMTSVADVTAVALYMNFFKQYVPWLAGIDQWVFAMTALVVVLAMNMLSVKVFGELEFWFSLIKVLALAIFLVVGVYFVIFGTPIEGHVTGFSLITDNGGFFPNGILPAFVIIQGVVFAYASIELIGTAAGETEDPRKVMPRAIRAVVLRLVVFYVGSVLLFTLLLPYTAYKAGESPFVTFFGSIGVEGADVIMNLVVLTAVLSSLNAGLYSTGRILHSMAVSGSAPAALAKMNKNGVPYGGIAVTAVVTVLGVALNAVVPSSAFEIALNLSALGIICAWAVIVLCQLKLWQLSQRGEIVRPDFRMFGAPYTGILTLIFLFGVLVLMAFDYPVGSWTIASLIVIIPALVIGWYLLRDRIYRLAAERAGSGVSH

SEQ ID NO: 20029 - protein, 129 aa, Triticum aestivum
MANERSAGEERGAADSVVWREEAGKFETPDGEAFLQYRLVVQPRASSGGGGASPAAMDMVHTYVPGSKRGQGLAARLCDAAFAHARRHGMRVIPTCSYISDTYLPRNPAWNDLVYKADEPKHSSTSSSM

SEQ ID NO: 20030 - protein, 357 aa, Picea abies
MGSLESERTVTGYAARDSSGHLSPYTYTLRNKGPEDVIVRVIYCGICHSDLVQMHNEMGMSNYPMVPGHEVVGVVTEIGSEVKKFKVGEHVGVGCIVGSCRSCSNCNGSMEQYCSKRIWTYNDVNHDGTPTQGGFASSMVVDQMFVVRIPENLPLEQAAPLLCAGVTVYSPMKHFGMTEPGKKCGILGLGGVGHMGVKIAKAFGLHVTVISSSDKKKEEALEVLGADAYLVSKDAEKMQEAAESLDYIMDTIPVAHPLEPYLALLKTNGKLVMLGVVPEPLHFVTPLLILGRRSIAGSFIGSMEETQETLDFCAEKKVSSMIEVVGLDYINTAMERLVKNDVRYRFVVDVAASNLDK

SEQ ID NO: 20031 - protein, 221 aa, Zea mays; identical to SEQ ID NO: 4856

SEQ ID NO: 20032 - protein, 452 aa, Corynebacterium glutamicum ATCC 13032
MDPSDLAWILAAFALVSLMFPGLSLLYGGMLGGQHVLNTFMMVMSSLGIISLVYIIYGHGLVLGNSIGGWGIIGNPLEYFGFRNIMEDDGTGDLMWAGFYILFAAISLALVSSGAAGRMRFGAWLVFGVLWFTFVYAPLAHWVFAIDDPESGYVGGWMKNVLEFHDFAGGTAVHMNAGASGLALAIVLGRRHSMAVRPHNLPLILIGAGLIVAGWFGFNGGTAGGANFLASYVVVTSLIAAAGGMMGFMLVERVFSGKPTFFGSATGTIAGLVAITPAADAVSPLGAFAVGALGAVVSFWAISWKKGHRVDDSFDVFAVHGMAGIAGALFVMLFGDPLAPAGVSGVFFGGELSLLWREPLAIIVTLTYAFGVTWLIATILNKFMTLRITSEAEYEGIDRAEHAESAYHLNSNGIGMATRTNFGPEIPEETVPDAVQVGVDKQKIADTRKASK

SEQ ID NO: 20033 - protein, 406 aa, Oryza sativa
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTFPCWLQYSNQFDLQRVAKAIKDKACNALLLKVNQIGSVTESIEAVKMSKRAGWGVMTSHRSGETEDTFIADLAVGLSTLLRIEEELGAAAVYAGAKFRAPVEPY

SEQ ID NO: 20034 - protein, 301 aa, Asarum caudigerum
AGLSSPPRERKRVRENLIFSLAFKFARFQNFRFSFSFAGGFIFFEFSSLFFFGLQEMGRGRVQLKRIENKINRQVTFSKRRTGLLKKAHEISVLCDADVALIVFSAKGKLYEYATNSSMETILERYERYSFAERELVADPESEGGWCLEYGKLKARVDALQKSHKHIMGEDLDSLSIKELQHLEQQLDVALKHIRSRKNQVMLDTISELQRKEKMLLEQNKALQKTMREKENAMVRQAQWEQDNQPQASRPSFMLSRPLPTLHIGSNYHQTRNTETEKQGDRPHSRSNSGIPAWMLSHMND

SEQ ID NO: 20035 - protein, 199 aa, Yersinia bercovieri
SSIGGWKGINESDMVLMPDASTAVMDPFFEDSTLIIRCDILEPGTMQGYDRDPRSISKRAEDFLKSSGIADTVLFGPEPEFFLFDDVRFGSSIRGSHVSIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 20036 - protein, 93 aa, Fragaria x ananassa
WESHIWDNGKQVYLGGFDTAHSAARAYDRAAIKFRGTEADINFSVGDYDEDIKQMSNYTKEEFVQILRRQSTGFARGSSKYRGVTLHKCGHWE

SEQ ID NO: 20037 - protein, 497 aa, Brassica oleracea var. botrytis
MVPPPQPSLFQLTFLTGDKPILTLDDEFISSHTKVLLISDASDKIWEVKLDGNRLAGGWEEFAAVNNFSEGNVLVFRHNGEEIFHVAVSSESDDDESDDTDDSESDDESNDTDDSESDDSEDNGEGDSSLVNKEADSSSDCFLRARVTPYSLTKDRLDLSKDFKFMLFDEHNKPCEIYLVNEKGRKWTLRLSRNISSGAFYITRGWANFCSANGLIRGDFCYFKLSESGERPVLLLCSHESGNGHEDKEEEEECPEADTLKICSVGGCSNEKNTPSRFLTQKFTPSRFKTGQLYISMLSSGGLRESGIKKTGEIILLDNDGRKWPSYLNKTGQPGGEWCYIRKGWREMCEANGVEVNDSFVLELICEAANPIFKLHSKIRNKGKGNIVTSKKRALHARTVERTPGVEIDGERGSKRGCTRVSNRSNTYLKGKQPESCSVSDQVANVRQSVLDTLNTIRHFKAELKTRERNLEASLLELDALGERILGISKILNNNLA

SEQ ID NO: 20038 - protein, 431 aa, Yersinia pestis CO92
MMMKKLLSVLGLGTVALLPSWAMAAAPAVADKADNAFMMICTALVLFMTIPGIALFYGGLLRSKNVLSMMTQVMVSFALVCVLWILYGYSLAFSAGNAFFGSFDMAMLKGIELTSLSGSFYQYIHVVFQASFACITVALIVGSFAERIRFSAVLIFAALWFTFSYLPIAHMVWGGGFLAMDGALDFAGGTVVHINAAVAGLVGAYLLGKRAGFGKEAFKPHNLPMVFTGTAILYIGWFGFNAGSASAANEIAALAFLNTVVATAGAILSWVFAEWALRGKPSLLGACSGCIAGLVAITPAAGTVGVGGALIIGLVGGVAGLWGVVLLKKWLRVDDTCDVFGVHGVCGIVGCILTGVFTSASLGGTGYAAGVTMGHQVGVQLFSVGVTVVWSGVVAFVAFKIAGLIVGLRVPEEQEREGLDVNSHGENAYNQ

SEQ ID NO: 20039 - protein, 307 aa, Arabidopsis thaliana
MSVVENFSSEPKAKRRKIEPTINESSSSLSSSSSCGHWYICHGICIGCKSTVKKSQGRAFDYIFDGLQLSHEAVALTKCFTTKLSCLNEKKLHLVLDLDHTLLHTVMVPSLSQAEKYLIEEAGSATRDDLWKIKAVGDPMEFLTKLRPFLRDFLKEANEFFTMYVYTKGSRVYAKQVLELIDPKKLYFGDRVITKTESPHMKTLDFVLAEERGVVIVDDTRNVWPDHKSNLVDISKYSYFRLKGQDSMPYSEEKTDESESEGGLANVLKLLKEVHQRFFRVEEELESKDVRSLLQEIDFELNVESVE

SEQ ID NO: 20040 - protein, 158 aa, Triticum aestivum
  unsure (1)..(158): unsure at all Xaa locations
MAEAAALEGSEPVDLTKHPSGIIPTLQXRNIVSTVNLDCKLDLKAIALQARNAEYNPKRFAAFIMRIREPKTTALFFFSGKMVCTGAKSEQQSKLAARKYARIIQKLGFPAKFKDFKIQNIVASCDVKFPIRLEGLAYSHGAFSSQPFSFVDVCTQTC

SEQ ID NO: 20041 - protein, 447 aa, Zea mays
  unsure (1)..(447): unsure at all Xaa locations
MECVTDMPLATLDSRPRKRQRLGWDVLPAEMYQVTRPRLGWDVGPAEMNQFALCGQEVVNAFSAAVLGLSSGCVSSQVNQEQPHDGSPPLRXKMTRMGIMFLXVGDNLTSRYKINAKMGEGTFGQVLECWDKETKEMVAIKIIRGIKKYRDAAMIEIGMLEKLGKYGESRSSCVQIRNWFDYRNHICIVFERLGPSLYDFLRKNNYRSFPIALVREFAKQLLECIAFMHELRLIHTDLKPENILLVSPEYIKVPDYKVSSQSPKEGSYYKQLPKSSAIKVIDFGSTTYDQHDQSYVVSTRHYRAPEVILGHGWSYPCDIWSVGCILVELCTGEALFQTHENLEHLAMMERVLGPLPYHMLKRADRHSDKYIRKGRLNWPEGCTSRESMKAVMKLSRLQNLVMQNVDQAAGDFIGLLQGLLKYDPASRLTAREALRHPFFTEGFGRRR

SEQ ID NO: 20042 - protein, 492 aa, Arabidopsis thaliana; identical to SEQ ID NO: 439

SEQ ID NO: 20043 - protein, 932 aa, Oryza sativa
MPAKTIRDRDAPGPQPSNIKATYWILVPSSRRDPDVLALLRTTTQADPNRARALRLSPPKNPKSPVTGGHDRTRRARVMAETNSPATMEAQAQVALTKSIQPDTSNEEMTSGNVAGNNVLLPLSNRTEAPTPRHVIVTISLDAGQNTMVDDNGVRQGLTDEESDTKTKLLERGVLTAASATAAMLSHFLKGVFNHHQEGYYIILVVFLMTGLILATTATWLARRHSAKVVVLLALVPQVLVADRPKCQPKHVYGAVSKQDATGLHGPDGLIYLHLSTTLVRVRSTHALTHAVDSVQKDPLSGPHRLPGPTIPLPKIRKPFGENKNRFDATVTTPLTVTDMWTTQRFGPHLRIRTSTTSLSHTGSRSSRRLRLRSVAPPRRLLAPPPPPPPRGRASPRGEVGLLLTAAVAAVVVKVRAISHFFVSSHAGLGLYIFLIILPFIVLCPLYYYHQKHPVNLILLGLFTVAISFAVGMTCAFTSGKVILESAILTTVVVFSLTAYTFWAAKRGRDFSFLGPFLFASLIVLLVFAFIQILFPLGRISQMIYGGIASLIFSGYIVYDTDNIIKRYTYDQYVWAAVSLYLDGSRLSSSHRVTSCSYTFSSVNVKMLCLYHESPINFDPAIEKRGYSATWHLPLPPSLRCPLHRPSVASACASLVCGGDMGKHNHHDVEAPAAGGSSFPPPPPAVGVAGVACTYMIERPELRWAFIRKVYAIVATQLVVTVAIAAAVYSVPAIRRFFLARTPASLAAFVLVIVAPLIVMLPTMFLRKKHPINLILLALFTICMSCAIGLGCLSSKAASLTFGLVFGLTLYTFWAAKRGHDFSFLRPFLVAAFLVLVLYGLIQMLVPTGKVATTVYGCVAALVFSGFIIYDTDNLIKRHAYDEYVTAAISLYLDTIVPQKLLAQVISHCPLFPRVHISNPELNSHRMNNRFQ

SEQ ID NO: 20044 - protein, 246 aa, Zea mays
  unsure (1)..(246): unsure at all Xaa locations
MGRGRVELKRIENKINRQVTFAKRRNGLLKKAYELSVLCDAEVALIVFSNRGKLYEFCSGPSITRTLERYEKNSYAGPDTAVQNKENELVQNSRNEYLKLKAKVDNLQRTQRNLLGEDLGSLGVKELDQLEKQIDSSLSHIRSTRTQHMLDQLTDLQRREQMMCEANKCLRRKLEETSNQVHGQVWEHGXANLLLGYERHSSPQQAPSHVGNGLFFHPLEAAAEPXTLQIGFAPEHMNNFMPAWLP

SEQ ID NO: 20045 - protein, 320 aa, Oryza sativa
PAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAVLIVCADSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 20046 - protein, 351 aa, Agrobacterium tumefaciens
MTIIPNLNIVPFVSVDHMMKLVLRVGIDTFLRELADVVEEDFRRWESFDKTPRIASHSQEGVIELMPTSDGTLYGFKYVNGHPKNMKEGRQTVTAFGVLSDVGNGYPLLLTEMTILTALRTAATSAVAAKHLARKNARSMAIIGNGAQSEFQARAFKAILGIDTVRLFDIDRTASEKCARNLAGQGFTIEICDSAQSAVEGADIITTVTADKQYATILTDNMVGPGIHINAVGGDCPGKTELHRDILLRSDIFVEYPPQTRIEGEIQQLPEDYPVTELWQVISGEKHGRVNDRQITLFDSVGFATEDFSALRYVRSKLAATGLYTELDLLADPDEPRDLFGMLLRCEATLA

SEQ ID NO: 20047 - protein, 301 aa, Thermoanaerobacter tengcongensis
MLKNEKLCNKLKEKKFVITVEISPPKGIDVTKTIEEARKLKGVADALNITDSPMANMRMSPIALAHILQDHLNIETIFHLTCRDRNLIGLQSELLGAYALGVRNILALTGDNPSLGDTPQARGVYDVDSVGLLKIIKALNSGFDYNGNKLDYPTSFCAGTTANPNDLRDEAIEKLHVKVEAGAEFIQTQPVYDEEILFKFLDKVKDLKVPVLVGILPLKSYKMALRLMEKVPGIEIPEKVIKRLQHGGKEEGINLSAEFIKNIKSEVAGIHIMPMGSVDFVFDIISKVEGIAISAKKAETK

SEQ ID NO: 20048 - protein, 941 aa, Neurospora crassa
MESTDRYIEISYSTTLLAESLDHPFVPPHKWCRKATCARPDQDIFPTLNLAELQRSRSRSRSIVQEHRSIFATMVKTIQLGSRLRYPITITKLYKEPNQPIKKKEALFQYSFKWKRTVGDNIRGETWEAEETTYADWSSPSDGELKSWKIRVGQEISRDQDCMVVKESCSHDVQFGGLCAICGKDMTEVNWAAESRDMDRAPINMVHDQTHLTVSETQAQKTENALQRRLLQHRKLSLVVDLDQTIIHACIDPTVGEWQKDPSNPNYPSVRNVKSFQLDDGPRGVANNCWYYIKMRPGLEDFLKKISTMYELHVYTMGTRAYAQNVARIVDPDKKLFGNRVISRDENGNMYAKSLQRLFPVSTKMVVIIDDRADVWPRNRPNLIKVSPYDFFKGIGDINSGFLPKQQGLLTPSAAATTNGGLARIAPAPSPDKEDSTTMEPPLEKALEEQEKTLEKQIKDRPLQALQEQQDKQDEAAERASATPESGNTESTTPPPPHHRHQVLQDDDRELAFLENHLTALHKSFFQAYEQNRLSQPSSSPSSLDTQSIPDVGSILTTLKAQALSGCKIVLSGIVPIGMDVYRSEIGLQVASFGAELRSSVTRDVTHLVVSSQRPRTKKVRQAIRYLPKIKIVNQDWLAACFSEWRVVEEGPYLIEGLEDAQKKLNEKVQDAEATETVSDADDTDSGNAPPGKKRILRLKSPPRVRFATAASTGNDEDEDEDEEDSDSGGDDEDEDEDMDEELEAFKPTDADGQLSPIDGLKTFNWGSADEELAEFLESGSDDEEEEEEDEDDDDGDNVNGDDDEEAPAQAATNITTTSSSYEQLLAAQGTAPSTKRKADDEEEEESHKRRKSLLGPGPSSLRNELKDEDVEATTAEVETQAAHDDQDVQYADDLDKEFEELDEEALEADFLAMDDGDGDEAQGQQVDGHGTGNGGVDENG

SEQ ID NO: 20049 - protein, 429 aa, Nostoc sp. PCC 7120 [sequence omitted]

SEQ ID NO: 20050 - protein, 337 aa, Mesembryanthemum crystallinum
MAKVKVGINGFGRIGRLVARVILQRDDCELVAVNDPFISTDYMTYMFKYDSVHGQCKSHEIKLKDEKTLLFGETPVAVFGCRNPEEIPWGQAGADFVVESTGVFTDKDKAAAHLKGGAKKVVISAPSKDAPMFVVGVNEHEYKSDLNIVSNASCTTNCLAPLAKVINDRFGIVEGLMTTVHAMTATQKTVDGPSMKDWRGGRAASFNIIPSSTGAAKAVGKVLPALNGKLTGMAFRVPTCDVSVVDLTVRIEKAASYEQIKAAIKEESEGKLKGILGYTEDDLVSTDFIGDNRSSIFDAKAGISLNDNFVKLVSWYDNEWGYSTRVVDLIMHISKCQ

SEQ ID NO: 20051 - protein, 348 aa, Zea mays
GLRPRNPRCPLARHPAPSSHPSSPRQAVGGGGLEMASDDERSIAADSWSVRSEYGSTLDDDQRYADAAEVLAASASSANFPSAASDYCSDKDDQDPGDVEGSMLGLQSYWDASYLEDLANFQEHGHTGEIWFGADVMDTVAVWTKSLCNIIEGKIPSGQDNIKSEVNENLFSNYPVLDVGTGNGLLLQALAKQGFTDLTGTDYSKGAVELARNLAARDGFSSINFLVDDVLETKLDRKFKIITDKGTLDAIGLHPDGRAKRMVYWESVSNLVEPGGIVVITSCNHTKDELLHEVEDFTKRKFGKENVDEGARDASEIFRYIDHVRTYPTIMFGGIEGSQVCTVAFQRV

SEQ ID NO: 20052 - protein, 376 aa, Oryza sativa (japonica cultivar-group)
MAKLGPGQGLGCEAAVGLLAPSRKREYKACNKLTEGKRPLYAIGFNFLDFHYYEVFATVGGNRVTTYSCLKDGNFAILQAYIDEDKDESFYTLSWACDLDGTPLLVAAGSNGIIRVINCATEKLLKTFVGHGDSINEIRTQALKPSLIISASKDESVRLWNVHTGICILIFAGAGGHRNEVLSVDFHPSDIYRIASCGMDNTVKIWSMKEFWPYVEQSFTWTDLPSKFPTKYVQFPVLVAVVHSNYVDCTRWLGDFILSKSVDNEIVLWEPKTKEQSPGEGSIDILQKYPVPECDIWFIKFSCDFHFNQLAIGNREGKVFVWEVQSSPPVLTARLTNPQCKSAIRQTAVSFDGSTILACSEDGSIWRWDEVDHPKA

SEQ ID NO: 20053 - protein, 510 aa, Pisum sativum
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 20054 - protein, 162 aa, Triticum aestivum
  unsure (1)..(162): unsure at all Xaa locations
MASNSSAAAVAALFGIREGHQQDQMKPLLAQHQRQHVAAPPSALQTAGPDQAAAAAPPVKKKRTMPDPDAEVNALTPKTLMATNRLVCQVCNKGFQRQQNLEQHRXGHNLPRKLNPKDPDQVQPAESNLSPEPTXVHHETGQAQGRTYRPLQSHFCRKPRLL

SEQ ID NO: 20055 - protein, 143 aa, Zea mays
SGGRGIEPGGAIDLGSGILFRPREVLLELARSRNRMPLPKSIAPPGSIPLPPEQDTLLAQNYQLLPPLKPPPQFEETEDENEESNPSLTPNPANSNPTFSQDQRSNEQQHTPQHGQRVSFQLNAVAAAAAKRPRMTVDQLNIG

SEQ ID NO: 20056 - protein, 406 aa, Oryza sativa
PRRSSHEDGEAEATGSDSEDGEDSPYDWPPLVCCFGAPRWEFVPTVRVSDRQMHPDIYSTWLHLQWEPPEFARAPGSAASNVAIALTRLGGRAAVLGKVGDDDFGRELVYRMNCERVQTRAIRFDDGAATATARMKVGFRDREDGSGGTRLVAETVKSAAEDSLSKAEINVDVLKEARVFHFNSEVLLTPSMESTLFRAIELSKKFGSKIFFDLNLPLPLWRSRDETKELINKAWNEADIIEVSRDELEFLLDHEYYQYKRANPPQYYLDGFHLTRNWPQYYHYTPEEIAPIWHDGIKLLLVTYGTLRIHYYTPKFHGCVIGTEDALITPYTTDRTGSGDAVVAAAIRKLTSCPEMYEDQDTLERNLRFAVAAGIISQWTIGAVRGFPTESAAQNLKEQVYVPSMW

SEQ ID NO: 20057 - protein, 214 aa, Trichodesmium erythraeum IMS101
MSQSDQNKVLRMLPIIAGGLGATLLMTNRFFTPNLLASQTRSDVVGVILSAFLILTGLLWQQIQPRSPDTVKLIGKSEFELLPELSEIVKTELAWASSLLLTNTVTKTVIIWHQEKVLLRRGILPSESYIKPGTILKQVLGKQKPIYLVDLKVYPGRIEFNYLPENTQGVICQPLGNNGVMILGANAPRSYTKQDENWISGIADKLTDTLSKKL

SEQ ID NO: 20058 - protein, 479 aa, Bacillus anthracis str. A2012
  unsure (1)..(479): unsure at all Xaa locations
ESEENMLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 20059 - protein, 402 aa, Odontella sinensis
MKLAVAALLAVQAAAFAPAPQFGAPRTAMHMSTETETEEKAFAKLPASVKPGVVTGKALLDLLDSAKEQGYAIPGVNVVGSNSINACMEAAKKYGGPIMVTFSKGGGQFIAGKAADNTDDKASIAGCVAAAKHVREVAALYGVPVVLHTDHCQKAWLPWFDGLMEANEEYYAQNGEPLFSSHMLDLSEEPLEENIAICKKYMERMAKIDMLLEFELGITGGEEDGVDNTDVDSARLYTQPEEVWYSYQQLSEIPNAMFTCAASFGNVHGVYAPGNVDLQPVILHNSQKYIQEKLETEDTKPMKFVFHGGSGSSVEDIRYAIEAGVIKMNIDTDTQWAYWDGIRAYEAKNHDYLQGQIGNPEGEDKPNKKYYDPRMALRSGEEAMADRLVKAAEDLNCVNVLN

SEQ ID NO: 20060 - protein, 431 aa, Methanopyrus kandleri AV19
MAAESIAKAVHDVLATWGAQGPGAIFFLVWAAVLVVGMQLGFMFLEAGQVRTKNVVSVLMKNLLDLSLGGIVFIFFGFALAFPDYAQSIGKWIATMFTANPWSADPMKAADPYNLAYCFFQFAFCATAATIVSGAVAERINFKACLVMTVLITGLLYPIFVLWTWGGGWMGGDTGLFAKVFGQPYHDFAGSTVVHAIGGFLAMAAAYLLGPRIGRFKNGKPVPIPGHNIPQAFLGALFLAITWYGFNVGSSAVLYDPTNESWISSLVATLAMCGGAAAAAFTTRFDPLWAANGLIAGLVAICAGCDIMSPFGALLTGIVAGLIIKPAFRLLEKLEIDDVVAACPVHGFAGVWGAIAAGIFGAEALGGAGGVSLAAQIVGALVCIAWALGSGFATFYVIDKVIGLRATEEEEKGLDETEFGVSAYPYMETRD

SEQ ID NO: 20061 - protein, 186 aa, Glycine max
MSAYRDEDPRLHGIKTKIRVVPNFPKPGIMFQDITTLLLDPRVFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKPLHVLVECFECCE

SEQ ID NO: 20062 - protein, 559 aa, Bacillus cereus ATCC 14579
MDDVVTESRNPISKFFAKIGRQKRYMRVSSIAIKHGMGKYLALKRSPEADRKLATSLRNTLEECGGVFIKFGQVLSTRSDLLPPVFIHELSNLQENVTRLSQKQVEEILKKELHTPKDEIFSSFEMEPLAAASIGQVHKAKLKENDQDVVVKLLRPNISETIKRDLDILIHFSLWISNKSTWAKNIGFLDLAHGFSIAMKEEIDFKIEARNFEQVSDSLKNSETKVKIPKVYKKYSNSKILVLEFLDGVSVKSGSALLNELQIDTKKVQRQLFDCILEQIFFKGIFHADPHPGNVYILRDGTPALLDFGSVGRLGTLQQDAFKRLLIGFERKNSYVLLDGLLQLVEKKPNVDKEGLEQSISQLLIQSTYGSTNGSEEFIQGLFQIIAEFELAFYPMVAGAFRSLITLEGTMLQLNPEFNLMDEAKRFAKDHAASFMPVNNYSSLKEAATNELLAMLPAMRRIPRKLDDLSSKLENGELSVKVGFFSDETNASFITTFISQFLIAFIGTAFGGISVGVLHLANSATEPNDQFLSVVGYGGLFISAILLVRVAIHAVRKFK

SEQ ID NO: 20063 - protein, 185 aa, Methanopyrus kandleri AV19
MEIQNIVASVDLKGEVNLDECSVILQGEYEPEQFPGLVYRLEDIGTVVLIFRSGKMVCTGAKNREQIYKSVERVREDLEKKCGVKFHGEPEVEIQNIVASIDFHVPLDLDTIAEVLVGDEDVEGIEYEPEQFPGLVLRLREPKVAMLLFYSGKAVCTGAKTEEEPEKAVKKIAEKIEKYGLKLTG

SEQ ID NO: 20064 - protein, 110 aa, Zea mays; identical to SEQ ID NO: 14516

SEQ ID NO: 20065 - protein, 318 aa, Rhodothermus marinus
MKVIEILEQATGPLISYEIIPPRRGGSLEEVLAVVEELMPFDPPFIDVTSHAAEVEYEPLPDGTLKPRIKRKRPGTIGICAAIKSRFGVETVPHLLCRGFTREETEDALIELHYLGIQNVMALRGDSPNYQKPIPPDRTVNEYAVDLVQQIANMNRGIYLEPLEDAVPTDFCIGVAGYPEKHFEAPNLTWDIMNLKRKIEAGAHYVTTQMFFDNRHYFRFVERCREMGITVPIIPGLKILTSKRHLQLLPSRFHIEIPEELVAEVEAAKPEHVPEIGIAWARRQAEELLEAGVPCIHFYIMLRADYVREVVAYLRKIA

SEQ ID NO: 20066 - protein, 76 aa, Glycine max
MAKHHPDLIMCRKQPGIAIGRLCEKCDGKCVICDSYVRPCTLVRVCDECNYGSFQGRCVICGGVGISDAYYCKECT

SEQ ID NO: 20067 - protein, 131 aa, Glycine max
SIPDGVSLPRVGHTATLVLGGRLLIYGGENSYRHRKDDFWVLDISAIPYPPCSITQQITVSSKKVLTRMWKRWKSSGHAANSRSFHRACADRSGCYLYVFGGMVDGFLQPAEPSGLRFDGELFLVELVLQL

SEQ ID NO: 20068 - protein, 96 aa, Glycine max
  unsure (1)..(96): unsure at all Xaa locations
SVSRTDSSTVGWGGPDGYVYHKAYLXMFCSKAKLDALEDKCMDATMVTYMDVNKDRNWEYNEGQTEANAVTWGEVTDKATIQPTIGDPVSINEWKD

SEQ ID NO: 20069 - protein, 358 aa, Buchnera aphidicola str. APS (Acyrthosiphon pisum)
MNILNVIRPGVMNGDEARIVFELAKKKQFAIPAVNCIGTDSINAVLETAARVKSPIIIQFSHGGASFIAGYKKKLSENQEQAIQGAVSGAQHVHLMAKHYEIPVILHTDHCPKETLSWIDGLLEVGQNYYFNNNRPLFTSHMIDLSKESLEENISTCKKYFKRIKNINMMLEIELGCTGGEEDGIDNTKIDKKLLYTQPQDVNYAYEELNTISKNFSIAASFGNIHGVYQPGNIDLRPIILKNSQEFVSSKHNLEKNPLNLVFHGGSGSNLKEIKESIQYGVVKMNIDTDIQWAAWKGVLDFYKQNKEFLQHQLGNTTNKHKPNKKYYDPRTWIRKSQESISIRLEQSFKELNSFNIL

SEQ ID NO: 20070 - protein, 503 aa, Yersinia pestis KIM
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 20071 - protein, 116 aa, Zea mays
TCRLLIVVYGILWGFSAPGPGADPKVDYACTPEEVQQHFQACGTVNREGVQEALNLNESELHGRQIKVAPKRTNVPGMKQRPPRGLLDSAALCATDLTSEVRGRVMKFNAKPAHGH

SEQ ID NO: 20072 - protein, 176 aa, Oryza sativa
ARGEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 20073 - protein, 466 aa, Bifidobacterium longum NCC2705
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 20074 - protein, 595 aa, Schizosaccharomyces pombe
MSSQLKSTWAPVPSTKPSQPCKIGTDFKGERIVYPANKAIIIREIEKQENCFQYNEHTAPTTVARFSPSGYYVASGDNQGNVRIWDCAGEDKILKNQVTAISGRITDLDWDGDSQRIIAVGEGKERYGHAFTADSGNSVGEIFGHSSVVNAVSLRKSRPFRAATASDDNSINFFHGTPYRFNRSLRVHSKFVYDVRYSPNDERFASAGADGKVYVFDGKTGDQVYEIDAHKGSIFSISWSPDSSQFVTSSAGYSCKIWDANTGSLIREWLSSDKKQLVGTVWPTKDLIIVVNSKGNLTYLNPSDCKVIDTIYGHQRSITAATLSPDATHFYTASYDGTVLSWDIGKQKAFPLVGESHTNQVMQMIMADDHVITIGMDDTLRVIDIKQGCFAKDNVFPTGYQPIGVCSVEDCLILVTVSDIQVLRSLTGVSTAKTIYQPSAVASHPLKSEFCVGGEDCCVYIHTLEKGELCEVAQCKDSTAPITCLAYSPDGKYLACGDASGKVVLYDANSREVITSRWAFHTGRILGMSWNAKSTHLATASLDTNIHIYSVERPMKYIAMKNAHSLGATQVEWVSENELLSTGSDAAIKVWSVTF

SEQ ID NO: 20075 - protein, 251 aa, Pseudomonas fluorescens PfO-1
MRRPMVAGNWKMHGTRASVAELINGLRHLALPSGVDVAVFPPCLYINQVIDGLKGKSISVGAQNSAVESMQGALTGEIAPSQLVDAGCSLVLVGHSERRQIMGERDGMLNRKFAAAQACGLIPVLCVGETLEQREAGKTLEVVGRQLGSIIEELGVGAFANAVIAYEPVWAIGTGLTATPQQAQDVHKAIREQLAAENSEVARGVRLLYGGSVKAANAVELFGMPDIDGGLIGGASLNADEFGAICRAAGN

SEQ ID NO: 20076 - protein, 458 aa, Ahnfeltiopsis complicata
PDYVVKDTDVLALFRVSPQPGVDPVEASAAVAGESSTATWTVVWADLLPACDLYRAKAYKVDAVPNTSDQYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYNTLLLPYLKVNLPQGIFFEQDWASLRKVTPVASGGIHCGQMHQLLDYLGDDVVLQFGGGTIGHPDGIQAGATANRVALESMVIARNEGRDYVAEGPQILQDAAKTCGPLQTALDLWKDITFNYTSTDTADFVETPTANV

SEQ ID NO: 20077 - protein, 504 aa, Neisseria meningitidis MC58
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGVGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQAGLL

SEQ ID NO: 20078 - protein, 472 aa, Pseudomonas aeruginosa PAO1
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLTNVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 20079 - protein, 119 aa, Zea mays
  unsure (1)..(119): unsure at all Xaa locations
RKHPGIPIGPLFQKFDGKCVFFDLYVRPCTLVRVFPEGHYGLFQGRCVIFGGVGLSTAFFSKECPPPEKGRAGFPKIVNFGSPQPGFFFXPKKYGFKKKFPKKRTWGWFPLAGGFVLWP

SEQ ID NO: 20080 - protein, 562 aa, Vibrio parahaemolyticus RIMD 2210633
MNNDKRPLYIPYAGPALMATPLLNKGSAFSAEERSSFNLEGLLPETTETIQEQVERAYQQYKSFESDMDKHIYLRNIQDTNETLFYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGPDYDAFVEEFIQAVQRRWPDALIQFEDFAQKNAMPLLERYKDRICCFNDDIQGTAAVTVGSLLAACKAAGTQLSKQRITFLGAGSAGCGIAEAIIAQMVSEGISDEKARSQVYMVDRWGLLQEGMPNLLDFQQRLVQKHSNTKEWENEGNGFSLLDVMRNAKPTVLIGVSGAPGLFSQEVIEEMHKHCKRPIVFPLSNPTSRVEATPNDIIRWTNGEALVATGSPFDPVVHEGRTYPIAQCNNSYIFPGIGLGVLAVNAKRVTDEMLMESSRALATCSPLAINGRGALLPPLEEIHLVSKKIAFAVAKKAIEQGVALEITDEALNDAIDQAFWQPVYRRYKRTAF

SEQ ID NO: 20081 - protein, 539 aa, Hordeum vulgare subsp. vulgare
MASRQQQQLQVLSALDGAKTQLYHFRAVVVAGMGFFTDAYDLFCISLVTKLLGRIYYADPSSPNPGSLPPNVAAAVNGVALCGTLAGQLFFGWLGDRLGRKSVYGMTLILMVVCSVASGLSFGHTPASVMATLCFFRFWLGFGIGGDYPLSATIMSEYANKKTRGAFIAAVFAMQGFGILAGGVVTLVLSTVFRSAFPAPAYQTDAAASTVPQADYVWRIILMLGALPAALTYYWRTKMPETARYTALVAKNAKKASLDMSKVLQSEVEAEPEKLDEIMARGEDYGLLTSRFAKRHGLHLLGTATAWFLVDVAYYSQNLFQKDIFGSIGWIPKARTMDALEEVFRISRAQTLIALCGTVPGYWFTVFLIDVIGRFWIQLVGFAMMAVFMLGLAVPYHHWTTPGNHVGFVVMYGLTFFFANFGPNATTFIVPAEIFPARLRSTCHGISAAAGKAGAIIGAFGFLYAAQSPDLAHVDAGYKPGIGVQKALYVLAACNLLGFLVTFLVPESKGKSLEEMSGEADAEEGNGANNVRPSGEQLV

SEQ ID NO: 20082 - protein, 784 aa, Thermoanaerobacter ethanolicus
MKPLYLDSTQSVEKRVEDLLQQMTIEEKVAQLNSIWVYEILDDMKFSFDKAKRLMSYGISQITRLGGASNLSPRETVRIANQIQKFLIENTRLGIPALIHEESCSGYMPKGATIFPQTIGVASTWNNEIVEKMASVIREQMKAVGARQALAPLLDITRDPRWGRTEETFGEDPYLVMRMGVSYIRGLQTESLREGIVATGKHFVGYGNSEGGMNWAPAHIPERELREVFLYPFEAAVKEPKLSSIMPGYHELDGVPCHKSKKLLNDILRKDWGFEGIVVSDYFAISQLYEYHHVTSDKKGAAKLALEAGVDVELPSTDYYGLPLRELIESGEIDIDFVNEAVKRVLKIKFELGLFENPYINEEKAVEIFDTNEQRELAYKIAQESIVLLKNENNLLPLKKDLKSIAVIGPNADSIRNMIGDYAYPCHIESLLEMRETDNVFNTPLPESLEAKDIYVPIVTVLQGIKAKASSNTEVLYAKGCDVLNNSKDGFKEAVEIAKQADVAVVVVGDKSGLTDGCTSGESRDRADLNLPGVQEELIKAVYETGTPVIVVLINGRPMSISWIAEKIPAIIEAWLPGEEGGRAVADVIFGDYNPGGKLPISIPQSVGQLPVYYYHKPSGGRSHWKGDYVELSTKPLYPFGYGLSYTEFSYTNLNISNRKVSLRDRMVEISVDIKNTGTLKGDEVVQLYIHQEALSVTRPVKELKGFKRITLDAGEEKTVIFKLSIEQLGFYDENMEYVVEPGRVDVMIGSSSEDIRLRDYFEIVGEKEKVAKKFITEVRVENK

SEQ ID NO: 20083 - protein, 329 aa, ASPERGILLUS NIDULANS FGSC A4
MSFKVFKGSEKGVIESTTKKPALEGDRVLVKVSHSGVCGTDLHYKAADMVLGHEGVGYVEEVGPDVKDLKKGDRVGWGYEHDCCGRCKHCLSGFETFCPERAMYGFADLDQGSFASHAVWREAFLFKLPDGLDNESAAPLMCGGSTVYNALVGAEVTPTDTVGIVGIGGLGHLAIQFAAKMGCYVIVFSGTDSKKEEAMKLGAKEFVATKDAKELKTSRKLNNLIVTTSFLPEWELFLNVLDNRATISPLTVSDKPFTIPNQEMLVKGLRVQGGIVAARQVHREMLQFAAFHGVKPIVMRYPMNEKGINECMKTLEEGKMRYRGVLAAE

SEQ ID NO: 20084 - protein, 430 aa, Ceratopteris richardii
MATNAVSSTHSASSLSYYSTRIVEPYLQSELLQGTQGFHRPHTSHCQRQVTSSVESLELSAVAGERGKADTAIAIDRSQGFEILSPTCNYVVSSNGETVLANPSLDSTGHANHEEGPSLPSRSMADRDDLIRTKIVSHPSYPRLVMAYVNCYKIGAPEDAALILEEVSRKYQEIRSSSSEVIGADPELDNFMELYCNVLQRYHEELTHPYKEAMAFFKKIELQLDAISKGSLSLSQSGETKTEANSDSAWHGQTGAAPSIEDEPEEGDMSSGEVDFHDEMIDPLAEDQKLKEQLLRKYSGYIFKLKQEFLKKKKKGKLPREARQMLLDWWTQHYKWPYPSEAEKTALAESTGLDQKQINNWFINQRKRHWKPSEDMQYVMMDSPAGQTQHTFLRPHSHIASQHLSPYTVLQTMEVAAGAAPSATMMSSLH

SEQ ID NO: 20085 - protein, 200 aa, SYNECHOCOCCUS SP. WH 8102
MLLVIDNYDSFTFNLVQYLGELAPHYPIAADLQVHRNDALTLAQIRELKPDAILLSPGPGDPDQSGVCLEVLQDLSPTTPTLGVCLGHQAIAQVHGGRVVRASQQMHGKTSPVLHNGEGVFAGLPQPLTATRYHSLIAERSSLPDCLEVTAWLEDGTIMGLRHREHRHLQGVQFHPESVLTDAGHQLLANFLKEANGERC

SEQ ID NO: 20086 - protein, 315 aa, Mycobacterium bovis
MARLTVITTGGTISTTAGPDGVLRPTHCGATLIAGLDMDSDIEVVDLMALDSSKLTPADWDRIGAAVQEAFRGGADGVVITHGTDTLEETALWLDLTYAGSRPVVLTGAMLSADAPGADGPANLRDALAVAADPAARDLGVLVSFGGRVLQPLGLHKVANPDLCGFAGESLGFTSGGVRLTRTKTRPYLGDLGAAVAPRVDIVAVYPGSDAVAMDACVAAGARAVVLEALGSGNAGAAVIEGVRRHCRDGSDPVVIAVSTRVAGARVGAGYGPGHDLVEAGAVMVPRLPPSQARVLLMAALAANSPVADVIDRWG

SEQ ID NO: 20087 - protein, 138 aa, Oryza sativa
MIHSKRLAQLARRLQRVKTTAAREDDACCTTSPVADKGRCTMYTADGRRFKVPLPYLGTTVFGELLRMSQEEFGFAGDGRITLPCDAAVMEYVMCLLRRNASEDVERAFLSSVVMSCQDSSCGVPPVALHQQFSVCSS

SEQ ID NO: 20088 - protein, 119 aa, Metrosideros excelsa
NKINRQVTFSKRRCGLLKKAHEISVLCDAEVALIVFSTKGKLFEYATDACMEKILERYERYSYAERQILTNNAETNGNWTLEHAKLKARMEILQKNQKNLMGEELDSLSLKELQNLEHQ

SEQ ID NO: 20089 - protein, 555 aa, Triticum aestivum
  unsure (1)..(555): unsure at all Xaa locations
VRPRVRPRVRPRVRLTRSPVITNHLFRHEQGEAFAASGYARASGRVGVCVATSGPGATNLVXALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPSGGAFKDMIMEGDGRTSY

SEQ ID NO: 20090 - protein, 603 aa, Methanosarcina acetivorans C2A
MFSKSDFRGIINSMGLVFGDIGTSPIYTLTVIFLLTRPTEVHVIGVLSLIIWTLITLVTVEYAWLAMSLGKKGEGGTIVLKELLVPLIKSGRNAAFITLLAYIGVSFLVGDGVITPAISILSAVEGLRIIPDFQDIGQGAIMFIAGIIAVALFSVQSKGTEEITWVFGPVMVLWFASLAFSGIASIFYTPGVLRAINPYYAISFLLHNGFTGFFVLSEVILCATGGEALYADMGHLGREPILKAWRLVFSALVLNYLGQGAFIIRNPESKNILFEMINQQAEVIYIPFLILSITATIIASQAMISGMFSIVYQGITTRIIPMLKIDYTSGKLRSQIYIGAVNWLLLISVLFMIFEFRDSHRLAAAYGLAVTGTMSITGLMMTLIFYLKGRMFRSFVSLFVTVIDVVFLLSNTYKIPHGGYWSIVIAAIAFSLIIIYTSGQKKLYELMNPMKIGDFLEKYKQVYASENKISGTALFFARDINYVPRYISNVMFENNIIYEDNIFISIIKCESPFGVKSSFAKDLAKGLRVFEINVGYMEVIDVVQILKDKGIQEKTIFYGIEDILTSNLIWKVFSVIKKLSPSFVQFYKLPSDKLHGVLTRFEM

SEQ ID NO: 20091 - protein, 189 aa, Haemophilus somnus 2336
MNTNLLVINNHDSFTYNLVDLIRRLGTPFKVVNVEDLSLVEIENFSHLLISPGPDVPHAYPQLFDLLEKYYQYKSILGVCLGHQTLCEFFGGKLYNLQNVRHGQAKQLKVRSNSRLFRNLPLTFQIGLYHSWAVSPENFPEDLEITAICDDEVIMAMQHKTLPIYGVQFHPESYISEFGKQIIQNWLSN

SEQ ID NO: 20092 - protein, 178 aa, Archaeoglobus fulgidus DSM 4304
MIVVVDCKDSFVYNLVEYISLFDKVRVVEKESAGLLRKMSFDGVVISPGPGKPDRSLEFVFKMGVPVLGVCLGHQMIAEVFGGKVGRVEPVHGKTSLVEHDGRGIFKGVRNPLRAGRYHSLAVLEPPEGFEVCAKSEDGVVMGLRRGKIHGVQFHPESVLTEDGVRMIRNFVEMCHDG

SEQ ID NO: 20093 - protein, 354 aa, Rosellinia necatrix
MCFGSRKTDEAGDARSRELDKIIKQDEKRMLKEVKLLLLGAGESGKSTVLKQMKLIYAQGFSKTEKLEWKPVVLINVIQSLRLIFDAMEDYNIEFERKENEKNKELVLLDVEIGPNDPLPQDYLQPIKSLWADSGVQKAILKGNEYALHDNIAYFCDDVDRLWDKNYIPTDQDLLRTRLRTTGITETVFDLGQLTYRMFDVGGQRSERKKWIHCFENVHCLLFLVAISGYDQCLVEDKDGNQMNEALMLWESIANSHWFAKSALILFLNKMDLFKEKLVSSPITSYGFTDYRGPADDHKLASKYFMDKFKALNRNPEKEIYGHFTNATDTNLLKITMTSVQDMIIQRNLKQLIL

SEQ ID NO: 20094 - protein, 480 aa, Membranoptera weeksiae
QAIKNERYESGVIPYAKMGYWDPDYVIKETDVLSLFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRMPVAYLKTFQGPATGIVVERERMDKFGRPFLGATVKPKLGLSGKNYGRVVYEGLKGGLDFLKDDENINSQPFMRWKERFLYAMEAVNRSVAASGEVKGHYMNVTAATMEEMYERAEFAKDLGTIIIMVDLVIGYTAIQSMAIWSRKNDMILHLHRAGNSTYSRQKIHGMNFRVICKWMRMAGVDHIHAGTVVGKLEGDPLMIKGFYDTLLLPYLETNLPLGIFFQQDWAALRKVTPVASGGIHCGQMHQLLDYLGNDVVLQFGGGTIGHPDGIQAGATANRVALESMVIARNEKRDYVTEGPQILRDAAKTCGPLQTALDLWKDITFNYTSTDTADFVETPTANV

SEQ ID NO: 20095 - protein, 549 aa, Zea mays
FGTRTSWGKFWLSVLGVFEWSGNNPVPPEVWLLPYLLPFHPGRMWCHCRMVYLPMCYIYGKRFVGRITPLVLELRKELFKDPYSKIDWDKARNLCAKEDLYYPHPFVQDVLWATLHKFVEPVMMSWPGSKLREKALETAMQHVHYEDENTRYICIGPVNKVLNMLACWIEDPNSEAFKLHIPRVYDYLWLAEDGMKMQGYNGSQLWDTAFIVQAIVATNLTEEFGPTLKLAHNYIKKSQVLDDCPGDLNDWYRHTSKGAWPFSTADHGWPISDCTAEGLKASLLLSKISPEIVGGPIEANRFYDAVSCLMSYMNDNGGFATYELTRSYAWLELINPAETFGDIVIDYPYVECTSAAIQALTSFRKLYPGHRRKEVDNCISKAANFIESIQKSDGSWYGSWAVCFTYGTWFGVKGLIAAGRTFESSPAIRKACGFLLSKELPSGGWGESYLSSQDQVYTNLKGNRAHAANTGWAMLALIDAGQAQRDPAPLHRAARVLINLQSEDGEFPQQEIIGVFNKNCMISYSQYRNTFPIWALGEYRCRVLGAGKR

SEQ ID NO: 20096 - protein, 272 aa, Novosphingobium aromaticivorans
MAFAGQVVWITGASSGIGAAMARALAAQGAKLVLSGRNEAALAELARNCGDALVLPFEATDYAAAASAAKKAWNWQGHIDMLVNNAGISQRSLAVDTAFEVYERIVAVDLLAPIALTQALLPRMAERKSGRIVMVSSIAGKVGSPMRTGYSAAKFGLFGYSDALRAEVAGLGIKVHVIAPGSIRTDVSRNAITADGSRRGVSDKAIENGLDPADAVDQMLSAIAADEREIIMGEGMEKEIGELRRTPDALHDRMAAVVAAGYAQKMDEGASE

SEQ ID NO: 20097 - protein, 253 aa, Helianthus annuus
MGKGRLELKRIENKINRQVTFAKRRNGLLKKAYELSVLCDAEVALIIFSTRGKLYEFSSTSSMLKTLERYEKCSFGPPEQRKPAKEDLQEQSSYQEYMRLKERYDALKQLERNYYGEEIDSLTTNELESLERQLHCSLKQIRTIRTQSLIDKLYEQQKMEHQLYEYNKTLRLRLDEESQAEALQWDVHAHAHANGMVYGHHHQHQVSHPAHGAFYHPTGCETTLQIGYQTEQISGATSSSMSHHHHQMQGWPA

SEQ ID NO: 20098 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGEAIIE

SEQ ID NO: 20099 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 20100 - protein, 365 aa, Oryza sativa (japonica cultivar-group)
MEELEGHRGEGRLPPPPPLLPFPKVSVQVYTVPSSSTAASAAAAGGARQAVAPATRDGGDGGGRAAGVLDDPVKARIVSHPRYHRLLAAFLDCHKVGCPAEAAEEIAAAARVREARQRAAAAASRMPPAPEDPELDQFMEDYCKLLVECKEELSRPLQEAEEFLRTVESELNSINSGPPLTALISESKAGLDSSDDDEHEDGSGMEMMEAAEDEDLGIIDPRSDDKALKRHLLRKYSGYLGGLRKELSKKRKKGKLPKEARQKLLTWWELHYRWPNPSEMEKIALAESTGLEQKQINNCFINQRKRHWKPTEEMEFAVMEAYHHQSTDAAAAFYVDVDARLVGATAAAPASAVYTARPDHGVWRA

SEQ ID NO: 20101 - protein, 296 aa, Vibrio fischeri
FESDNPDKIEVVAVNELSQPEAMAHLFQYDSTHGRFQHKVTHDQEYLYIDLPNGSQDKVRILHQADLSLLPWQSLEVDLILDCTGVYGSKADGEKHINAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKM

SEQ ID NO: 20102 - protein, 297 aa, Salmonella typhimurium
MMNLKAVIPVAGLGMHMLPATKAIPKEMLPIVDKPMIQYIVDEIVAAGIKEIVLVTHHSKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 20103 - protein, 374 aa, Zea mays
MALMQESSSQDLLQAHDELLHHSLCFAKSLALAVALDLRIPDAIHHHGAGGATLLQILAETALHPSKLRALRRLMRVLTVTGIFSVVEQPPAGGGDDSTVHTSDDEAVVVYRLTAASRFLVSDDVSTATLAPFVSLALQPIAACPHALGISAWFRQEQHEPSPYGLAFRQTPTIWEHADDVNALLNKGMAADSRFLMPIVLRECGETFRGIDSLVDVGGGHGGAAATIAAAFPHLKCSVLDLPHVVAGAPSDGNVQFVAGNMFESIPPATAVFLKKTLHDWGDDECVKILKNCKQAISPRDAGGKVIILDMVVGYGQPNIKHLETQVMFDLYIMTVNGAERDEQEWKKIFIEAGFKDYKILPILGALSVIEVYP

SEQ ID NO: 20104 - protein, 585 aa, Raphanus raphanistrum
  unsure (1)..(585): unsure at all Xaa locations
TFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQXQLAIPNWDQPMRLPGYMSRLPQPPEVSQLRQIVRLISESKRPVLYVGGGSLNSSEELGRFVELTGIPVASTLMGLGSYPCNDELSLQMLGMHGTVYANYSVEHSDLLLAFGVRFDDRVTGKLEAFASRAKIVHIDIDSAEIGKNKTPHVSVCGDVKLALQGMNKILENRGEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARESEIFPNMLQFAGACGIPAARVTKKEELREAIQTMLDTPGPYLLDVICPHQEHVLPMIPSGGTFKDVITEGDGRTKY

SEQ ID NO: 20105 - protein, 99 aa, Triticum aestivum
  unsure (1)..(99): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLXFSKVXFIFR

SEQ ID NO: 20106 - protein, 476 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKSYRFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 20107 - protein, 533 aa, Helicobacter pylori J99
MEIRNIKEFEKASKKLQKDTLKIALALLFLIGAALLALIFGQANSKGLLLIFAAVIGGYMAMNIGANDVSNNVGPAVGSKAISMGGAILIAAVCEMLGAIIAGGEVVSTIKGRIVSPEFINDAHVFINVMLASLLSGALWLHVATLIGAPVSTSHSVVGGIMGAGMAAAGMSAINWHFLSGIVASWVISPLMGALIAMFFLMLIKKTIAYKEDKKSAALKVVPYLVALMSLAFSWYLIVKVLKRLYAVGFEIQLACGCVLALLIFILFKRFVLKKAPQLENSHESVNELFNVPLIFAAALLSFAHGANDVANAIGPLAAISQTLEDASSPMGSTLNSVPLWIMVVGAAGIALGLSLYGPKLIKTVGSEITELDKMQAFCIALSAVITVLLASQLGLPVSSTHIVVGAVFGVGFLRERLREQSRRRFARIRDNIVAAHFGEDLEEIEGFLERFDKANLKEKSLMLESLKKSKNTAIALELKKKEKKSLKKVYKEEVIKRSILKKIVTAWLVTVPVSALLGALLFVALGFIEKYF

SEQ ID NO: 20108 - protein, 186 aa, Triticum aestivum
LAVRDRLLEDWNLTEEMMKAKNPKRCYYLSMEFLIGRALDNALHCLKMKEAYRQGVQDLGFRLEDLLEQERDAALGNGGLGRLAACYMDATATLDYPTWGYGLRYQYGIFKQLINKEGYQTEMPDYWLDPNINPWEFPRNDVLYEVQFYGYVATKMNDKGESRMSWEGGQKVQAMAYDVPIPGFGT

SEQ ID NO: 20109 - protein, 340 aa, Helicobacter pylori 26695
MANLENLDWKNLGFSYIKTDFRFIATYKNGSWSQGGLVSENMLQLSEGSPVLHYGQACFEGLKAYRSQKGKALLFRPLENAKRLQTSCERLLMPKVSEELFLRACAEVVKANQKWLAPYKSGASLYLRPFVIGVGDNLGVKPANEYLFIVFCAPVGAYFKGGIEKGGARFITTIFDRAAPKGTGGVKVGGNYAASLLAHKMATEQGYDDCIYLDPTTHTKIEEVGAANFFGITHDDAFITPHSPSILPSITKKSLMVLAKEYLNLKVEEREILMDELDAFKEAGACGTAAIITPIKEIVHNNKSYFFEAPGHITKRLYDLLLSIQQGEQEAPKDWIFEVG

SEQ ID NO: 20110 - protein, 610 aa, Neurospora crassa
MDESFIGKTGGEIFHEMMLRHGVKHIFGYPGGAILPVFDAIYNSPHFDFVLPRHEQGAGHMAEGYARASGKPGVVLVTSGPGATNVVTPMADALADGTPMVVFSGQVPTTAIGSDAFQEADVIGISRACTKWNVMVKSVAELPRRINEAFEIATSGRPGPVLVDLPKDITAGILRRAIPTDTAIPTSPSAASRAAIELSRKQLDASIQRVAKLVNIAKKPVIYAGHGVVQSKGGPALLRALSEKASIPVTTTLHGLGAFDELDEKSLHMLGMHGAAYANMAVQEADLIICLGGRFDDRVTLNLNKFAPAAKAAAAEGRGGIVHFEILPKNINKVVQATEAVEGDVATNIELLIPQVDAKTMADRKEWFGKINEWKSKWPLSDYERAERTGLIKPQTLIEELSKLTEGRKENTYIATGVGQHQMWTAQHFRWRHPRTMITSGGLGTMGFGLPAAIGAKVAKPDALVIDIDGDASFGMTLTELSTAAQFNIGVKVIVLNNEEQGMVTQWQNLFYDDRYSHTHQKNPDFVKLADAMGVQSKRIIKPEEVVEGLKWLIDSEGPALLEVVTDKKVPVLPMVPAGCGLDEFITFDQERDRKRRELMVKRTGGVHGL

SEQ ID NO: 20111 - protein, 293 aa, Glycine max
MVVKPIEDIVVTNTCPKAVESKPRPQKEQAINCPRCHSINTKFCYYNNYSLTQPRYFCKTCRRYWTEGGTLRNIPVGGGSRKNKRSSASCSTPNNSHNNNNSTNKKLLSDLVITPPTLSHTQNPNSNNTIHQGQDLNLAFPSSTPDFRKISELVQQNNNNNNSSNNSMSASASSSSTTTTTSTSHLSALELLTGITSSSSAGLTSFMPVPVPSDPNSIYTCGFPLQDFKPTLNFSLDGIGNGYTSLQNVQSGRLLFPSDDLRQVSSSTITTMDQKQQGDSTGYWTGMLGGGSW

SEQ ID NO: 20112 - protein, 394 aa, Halobacterium sp. NRC-1
MDVHFATVRSTNSSEGTLDVLIDGQAVTIEDNTEGDRSVGDLVEVWIDKGGRVAVEEVGRASPSVGVIREAIGGNEYLVERNGRVEVCESLDAENPEEGATVKIYGGKVTATISDEVIAPKGIEDRFGEQNRSKAYLKDPEEISEVDSGYDDVGGLTDTIEEVKDVVEIPLRESDKETNRFNKHGVEPDTGILFHGPPGTGKTLLAKAVAKETGSSIYLVNGPEIISKWYGETEDIIREIFSNAKKKKRAIIFIDEVDSIAPDRGDTKQFQRKIVAQLLTELDGFEPLNDVVVIGATNALNEVDSAIIRPGRFDRKIKFSKPTQTERMEIIEKITKDVDFGESVDLQLFAESTDGWTGADLSGVISRAVTISIRREGDLVTQDDLFRAIKGAGE

SEQ ID NO: 20113 - protein, 454 aa, Bacillus subtilis
MTSLIKIHAHGRRFEIFRSRGNPTVEVDLYTAKDLFRAAGARRCVHCHLRGPRTPRCCCLDPASYEMGLKGCYAHQYNYKTCSGSQETGCCEAGEDCPADDADGRHSSQLYDLIKKHPASVPGCLQGCCRGEGGALYRHIADFAGNPEVTLPVPAFIVINGGSHPANKFAQEFILLPVGASSFRTAGPAEVYHNLKNVIKEKYGKDATNVGDEGGFAPNILENKEALELLKSAIAKAGYTDQVVIGDVAASEFYRAGKYDLDFKSPDDASRYITPDQLADQLKSFTTCISSLLLTLPDASLQSRFGYYPDGDQPQAHRAGSGGEGLQLPPLEVTESLQACKLAQSNACGVIVSIDLRRLRTLFIADLFFGRVRADQDFSPCPICACQVECSFESRGLGRANKAKFAGRSFGPPLAKFPNLTAGHACTKYTPEQVSSRRGGGKTTTPNNPPSFCC

SEQ ID NO: 20114 - protein, 459 aa, Rhodobacter sphaeroides
MKDEEVEYVDIRFTDPRGKLQHVTLVADLVDEDFFEEGFMFDGSSIAGWKSIDQSDMKLIPDAGSVYIDPFYAEKTLCVHCNVVEPDTGEAYSRDPRGTAVKAEAYLKASGIGDVAYFGPEAEFFIFDDVRYSVTPAKVAYQIDADAAAWNTDSEYEMGNLAHRAGHKGGYFPVNPIDEAQDLRGEMLSTMKRMGMKVDKHHHEVATCQHELGLIFGGLTEQADNILKYKYVIHNVAAAYGKTVTFMPKPMKGDNGSGMHVNMSIWKDGKPLFAGDKYADLSQEALWFIGGILKHAKALNALTNPATNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALEELEKDHDFLLAGDVFTKDQLEGYMALKWEEVYAYEHTPHPVEYQMYYSC

SEQ ID NO: 20115 - protein, 483 aa, Streptomyces avermitilis MA-4680
MTQGPLTTEAGAPVADNQNSETAGVGGPVLVQDQLLLEKLAHFNRERIPERVVHARGAAAYGTFTLTRDVSQWTRAAFLSEVGKQTETFLRFSTVAGNLGSADAVRDPRGWALKFYTEEGNYDLVGNNTPVFFIKDAIKFPDFIHTQKRDPYTGSQEADNVWDFWGLSPESTHQVTWLFGDRGIPASYRHMNGYGSHTYQWNNEAGEVFWVKYHFKTDQGIKNLTTEEAVNVSGLDPDSHQRDLRESIERGDFPTWTVQVQIMPAAEAAGYRFNPFDLTKVWPHEDYPPIEIGKLELNRNPENIFAEVEQSIFSPAHFVPGIGPSPDKMLQGRLFAYGDAHRYRVGINADHLPVNRPHATEARTNSRDGFLYDGRHKGTKNYEPNSFGGPFQTDRPLWQPISVTGVTGDTEAPVHTEDNDFVQAGNLYRLMSEDEKTRLVDNLAGFISKVSRDDIAERAINNFRQADGDFGKRLEAAVQALRG

SEQ ID NO: 20116 - protein, 445 aa, Bifidobacterium longum DJO10A
MDKQQEFALRTVEERDVRFIRLWFTDVLGTLKSVAIAPAELEAAFEEGLGFDGSAIEGMTRVSEDDMIVQPDPSTFQILPWRGGPQGTARMFCDILTPDGEPSLGDPRHVLKRTLAKAKDKGFTFYVHPEIEFYLFESQDDWSKAPTPIDEGGYFDHVPRSPGMDFRRATVNMLEQMGISVEYSHHEAGPGQNEIDLRYADALTMADNIMTFRTVVKEISLERGIHASFMPKPLADAPGSGMHTHLSLFEGDSNAFYEAGQEFNMSLTARQFAAGILYHAAEICAVTDQYVNSYKRLWGGNEAPSYICWGHNNRSALLRIPQYKPGKGNSARMEFRALDPVANPYLAYSVLLAAGLDGIDKQMQLGEPTSDDVWELTDGERQAMGIQPLPRSLDEALKIMEKSDFVADVLGEHAFGYFLDNKHQEWEEYNQQVTPYELKKYLPKL

SEQ ID NO: 20117 - protein, 63 aa, Zea mays
MPELLASLDKNEAEIWPSTLYAIACVHEGVPFVNESPQNTFVPGLMELAIKQNSVIGGESLGP

SEQ ID NO: 20118 - protein, 635 aa, Photobacterium profundum
MKHDSKTLDLICMGRVAVDLYGQQIGARLEDMGSFSKYLGGSSGNVAYGTARQGLKSSMLARVGDEHMGRFLREELNSVGVDTSHLITDEERLTALVILGIKDEETFPLIFYRDNCADMAITADDVSEEYIASARCLAITGTHLSNPQTRDAVLTALKYARRHGVKTALDIDYRPVLWGLTSLGDGENRFIESGKVTDQLQEVLGLFDLIVGTEEEFHIAGGSTNSIDALRAVRQVSQAELVCKRGALGCSVFSNDIPNDLDDGITIQGVRVDVLNVLGAGDAFMSGLLRGYLSDEGWEKACAYANACGALVVSRHGCAPSMPTKVELDDYLSRANDVPRPDIDARLNHLHRVTTRKPNWEELCVLAFDHRIQFVDMVREAGVDFDSIKPLKKLILQASQEVVEEAGLQGKAGILCDGTFGQDVLNEVTGSGWWIGRPIELPGSRPLRLEHGNIGSQLVNWPLEHVVKCLAFFHPDDQHPLRLEQEKMIKEVYTACCQSGHELLLEVILPADMSSSDDLYLRAVQRFYNLGVKPDWWKLPPQSVEGWNNISAVITERDTYCRGVVILGLDAPEAELKAGFAAAANQPLVKGFAVGRTIFGQPSRDWLAGKIDDRALIEKIKVNYHNLITLWRQRG

SEQ ID NO: 20119 - protein, 245 aa, Zea mays; identical to SEQ ID NO: 12879

SEQ ID NO: 20120 - protein, 235 aa, Desulfitobacterium hafniense
MGLINFISFSRRIRRREEEVDPITLGQRLRNALEELGPTYVKIGQIASTRPDIIPDYLITELEKLQDQVPPFSFAEVSQIIEAELGALPQDIFRHFEEEPLAAASIGQVHRAVLQSGESVAVKIQRPHIAQKIETDLEILLDLAALAEKRMDWAALYHVRDMVEEFANSLRNELNYEIEGNNAQRIRKQFQGDSSIHIPKVYKEYSTKKVLTLEYIQGVKLSQFQTLEALGYNRK

SEQ ID NO: 20121 - protein, 453 aa, Nostoc sp. PCC 7120
MTVTQNLPNGPRIPRLLRLFKFITQPIQYVEDFAKVYGDNFTIWGSGESYFVYFSHPQALEQIFTNVSCFESSGGGSPLLELLLGKNSLILLEGDRHQRQRQLLTPPFHGERMRAYGQTIREITQQVTQAWQMGKPFNIRASMQEITMRVILRVVFGVDEGELFQELRQLLTTLLDFMGSPLMSSTFFFSFTQKDYGAWSPWGRMVRLIKKIDQLIYALIAQRRAEFGENRQDILSLLISARYDDGQPMSDVELRDELMTMLVAGHETTASALTWAFYWIDSVPEVREKLFQELDTLNDDSEPSIIAKLPYLTAVCQETLRFYPIVLNAFFRRTKNPMEIMGYKLPKATLVVPSIYLAHHREEVYPQSKQFRPERFLEKQFSPYEYLPFGGGNRRCIGLAFAQYEMKIVLATILSQFQVSRLSKRPVQPVRRGLTLAAPGGMKMVANKRMRNS

SEQ ID NO: 20122 - protein, 126 aa, Beta vulgaris
KFYTREGNFDLVGNNFPVFFIRDGMKFPDMVHSLKPNPKSHIQENWRVMDFFSHHPESLHMFTFLFDDIGVPANYRHMEGSGVNTYTLINKAGKVHCVKFHWKPTCGVKSLLEDEAIKVGGANHSH

SEQ ID NO: 20123 - protein, 443 aa, Chlorobium tepidum TLS
MAKKISAAVMLFFAVMMAHGTVWAGEPVSIDTGTTSWMLTSTALVLLMVPGLAMFYGGLVRTKNVIGTMMHSFGAMVIIGVLWPLVGYSLSFGHGILGGLVGWDPKYFMLQGIDDTIMASHIPEYVFAMFQGKFAIITPALIAGAFAERVNFKGYLLFIALWSIFVYSPICHWVWAGDGFLFNLGAMGAIDFAGGTVVHISSGVTGLVAALFLGSRRGYPSNVTSPNNLVMTLVGAGLLWVGWFGFNAGSAIASDLATARALTVTQVAAASGAFTWLIIELVHHNKATSLGVASGILAGLVAITPAAGVVQPSGAFALGAIAAIVCYLGLMLKSKLGYDDSLDAFGVHGVGGIVGALCLIFFIRPSWMADAAVKAGGSWTVWQQLGVQATAVGITVVYAAVVSLVILFIVEKTIGLRAKENDEMSGLDHSMHSEQGYGLINPN

SEQ ID NO: 20124 - protein, 339 aa, Listeria monocytogenes EGD-e
MSKDIDWSNLGFSYIKTDKRYISYWKDGEWDEGALTEDNTLHISEGSTALHYGQQCFEGLKAYRCKDGSINLFRPDRNAARIQKSCERLLMPHIPTEKFIDAVMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQAAKERNFGDCIYLDPATHTKIEEVGSANFFGITKDDKFVTPYSPSILPSITKYSLLYLAEHRLGLEAVEGDVYIDKLDEFKEAGACGTAAVITPIGGIQTKDDFHVFHSETEVGPVTKRLFDELCGIQFGDVEAPEGWIYKVK

SEQ ID NO: 20125 - protein, 347 aa, Staphylococcus epidermidis ATCC 12228
MSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRPTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSKIFKLLKEKYL

SEQ ID NO: 20126 - protein, 473 aa, Zea mays
MATAAVSVDEKLDKLRAEVAKLDQISENEKSGFISLVSRYLSGEAEQIEWSKIQTPTDEVVVPYDTVASPPEDLEETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLSSKGKSGKDGWYPPGHGDVFPSLNNSGKLDILLAQGKEYVFVANSDNLGAIVDIKILNHLINNQNEYCMEVTPKTLADVKGGTLISYEGRVQLLEIAQVSDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPSRANPANPSIELGPEFKKVANFLGRFKSIPSIVELDSLKVSGDVWFGSGITLKGKVTIIAKPGVKLEIPDGDVLENKDVNGPEDL

SEQ ID NO: 20127 - protein, 797 aa, Streptomyces coelicolor A3(2)
MTADVAVETTPEIPLWNDPNHPVATRVDALVAAMTLEEKIAQLYGVWVGASDQGGEVAPHQHDMEEAVDLDALVPAGLGQLTRPFGTVPVDPALGALSLMRTQARITSAGRFGIPAVAHEECLAGFAAWGATAYPVPLSWGATFDPDAVRRMAAAIGRDMRSVGIHQGLAPVLDVVRDARWGRVEETIGEDPYLVGTIGTAYVQGLESAGIVATLKHFVGYSASRAGRNLAPSSVGTRERADVLLPPFEMAVREGGSRSVMSAYTDIDGVPAAADEALLTGLLRDTWGFEGTVVADYFGIAFLKTLHGITADWADAAGAALKAGLDVELPTVKTFGTPLVDAVTDGRVPEALIDRALRRVLGQKAELGLLDPDWSPVPPALDGVDLSHPEALRGRIDLDRPENRELAREIAEKAVVLLTNDGTLPLARPRRIALIGPNAAEATAVLGCYSFPRHVGVQHPEVPVGLDLPTLYDTLTAEFPDADITLARGTGVDDGEVSGIGEAVDAARAADVVVAVLGDRAGLFGRGTSGEGCDAESLTLPGAQQRLLDALLDSGTPVVTVLLAGRPYALGRAIAESAAIVQSFFPGEEGTAALAGVLSGRTSPTGRLPVSVPGSAGAQPTTYLGARLAQASEVSNIDPTPAFGFGHGLTYTTFAWSDLVAHTKEAPTDGAFSLELTVRNTGERHGTEVVQLYLHDPVASVVQPVQRLIGYTRVPLAPGEARRVRVEVPADLASFTGRDGRRIVEPGDLELRFAASSTEPRLTATVALTGPERRVDHTRRLHAVFAQETVEGAVEGA

SEQ ID NO: 20128 - protein, 411 aa, Desulfovibrio desulfuricans G20
MDIYTVFLVLAVGAGFMMAFNLGANDVANSMASSVGSKAITVKQAVMIAGVLNFVGAVFLGAHVTKTISKGIINADMITDPRVMMVGMFAALLSAALWVLVATLTSLPVSSTHSIVGSILGFGIVAGGPEVVNWGSMGFVVLSWIISPLFGAGIAFFVFSHIRRFILYRTKIIEKARFWAPFWIALTADLVVLSFFYKTPVGKSLNLHWSVALGLTAVLTVAVWTGFRVLFTRTLPKDADGPEAVEDMFRRLQVGTACYVAVSQGANDVANAIGPVAAIYLIARERTLLASAEVPLWLLVIGGLGIALGIAVLGHKVMATVGEKITKLTNTRGFSVEFGAATTVLMASNLGMPVSSTHAAVGSIVGVGLARGFGAVDFRVLYKIVLYWVLTVPIAAITSIVIFQLLRWSFL

SEQ ID NO: 20129 - protein, 316 aa, Salmonella typhimurium LT2
MSMNKAVSSEQKPLDVICLGRVAVDLYGQQIGSRLEDMTTFAKYLGGSSGNVAYGTAIQGLRSAMLARVGDEHMGRFVREELNRVGVDTQCLLSDRDRLTALVILGIKDQDTFPLIFYRDNCADMALTPEDIREDYIASSRALAVTGTHLSHPNTRAAVLKALEYAQKHGLRRALDIDYRPVLWGLTSLGDGETRFIASSQVTEQLQQVLRHFDLIVGTEEEFHIAGGSTDTLTALRRVRQLTQAVLVCKRGALGCSVFEGNIADDWSQVKIHSGVRVDVLNVLGAGDAFMSGLLRGYLNDESWEQACRYATPAAR

SEQ ID NO: 20130 - protein, 324 aa, Triticum aestivum
AVVFVMFITTLLVTLVMAMIWKTSLLWIALFPIIFGGAELLYLSSAFYKFVEGGYLPLGFAAILMLIMGTWHYVHVHRYKYELKNKVSNNYVADLATRRNLARLPGIGVLYSELVQGIPPILPHLVEKVPSIHSVLVITSIKYLPISNIETNERFLFRYVEPREYRVFRCVVRYGYNNKVEDPREFENLLIGNLKQFIHQESLYSESSHSLEGEDNAFEESGDAMEPSVEVQDARLPKRFLDGITASPVNGLMDEIEFIQRGMDDGVVHLLGETNVVAEQNAGLVKKIIVDYAYNFMRKNFRQPEKITCVPHNRLLRVGMTYEI

SEQ ID NO: 20131 - protein, 555 aa, Oryza sativa (japonica cultivar-group)
MADADGGSNLAVLDALDSARTQMYHMKAIVIAGMGFFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANFGPNSTTFVLPAELFPTRVRSTCHAISAAAGKAGAIVAAFGIQKLTYNSQVKSIKKALIILSITNMLGFFFTFLVPETMGRSLEEISGEDGNTGAGGGGAPAAANAGVGVSASDVSRDEKFPASSTEWQTSMHA

SEQ ID NO: 20132 - protein, 328 aa, Ideonella dechloratans
MSQRQVAYVFDLNKCIGCHTCTMACKQLWTNRDGREYMYWNNVETRPGKGYPKNWEGKGGGFDQEGKLKTNGIIPIMADYGGRIGDFNLNEVLLEGKADQVVPHEKATWGPNWDEDEGKGEFPNNHSFYLPRICNHCSNPACLAACPTKAIYKRPEDGIVVVDQTRCRGYRYCVKACPYGKMYFNLQKGKSEKCIGCYPRVEKGEAPACVKQCSGRIRFWGYRDDKNGPIYKLVEQWKVALPLHAEYGTEPNVFYVPPMNTTPPPFEEDGRLGDKPRIPIEDLEALFGPGVKQALATLGGEMAKRRKAQASELTDILIGFTNKDRYGV

SEQ ID NO: 20133 - protein, 349 aa, Synechocystis sp. PCC 6803
MVSIRPSVRHTPAYVPGEQPQTNDFIKLNTNENPYDPPAQVLAAVAAELPKVRLYPDPVSTQLRQAAADLYGVDLNQVLAGNGSDDILNIVVRTFVDPGETVAFLDLTYSLYETIASVHGAKVQKIATDANFDLTGPVICPEAKLIFLASPNPPKGKHLNREFLWQTCAQAEGVVVIDEAYGDFSDEDHWDFLQEFDNVIISRTLSKSYSLAGMRVGLAIAAPALIEEMDKVRDSYNLDRLAQVLGTAALRNQAEFVPLWEKVRHTRTRLMEQLAELDFQVCPSDANFVFAAPRWMAAADLYQALKEKKILVRYFNHPRITDYLRITVGTDGEIDQLLLAIASLKGSLG

SEQ ID NO: 20134 - protein, 411 aa, Streptococcus mutans UA159
MDSGSIAFIIICSALVFLMTPGLAFFYGGLGRRKNVINTMMMAVVPLALASLLWVVVGYSLSFSGVGKVFGDFSHVFLNGVKEGASSRGLTIPDTLFSGFQMMFSIITVAILTGAVAGRMRFTPLVIFIIFWLLLVYYPFAHMVWDDGLLAKWGTLDFAGGDVVHITSGVSGLVLALVVGKRRDYDRLEYRPHNIPFVLLGAGLLWFGWFGFNAGSALAANGLAVHALLTTHISAAAAMFSWLLLEKYLNGKPSLVGGSTGLVAGLVAITPGAGFVPLWSSLLIGLMVSPLCYFAIAVLKSKFGYDDALDAFGCHGIGGIFGGIVTGLFTTPHLALDKSNIGLIYGNARLFLVILAAILFTIIWSALISFLIIKVISLFMPIRVSDREEATGLDDKEHGETAYPTFMGLDS

SEQ ID NO: 20135 - protein, 335 aa, Schizosaccharomyces pombe
MAIPKVGINGFGRIGRIVLRNAILTGKIQVVAVNDPFIDLDYMAYMFKYDSTHGRFEGSVETKGGKLVIDGHSIDVHNERDPANIKWSASGAEYVIESTGVFTTKETASAHLKGGAKRVIISAPSKDAPMFVVGVNLEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDSVVSTDFCGDNHSSIFDASAGIQLSPQFVKLVSWYDNEWGYSHRVVDLVAYTASKD

SEQ ID NO: 20136 - protein, 128 aa, Triticum aestivum
MQGDHAEKRGKVKKGWLAVRVGQAEQQGDGFRRFVIPIAYLYHPLFERLLEAARDTYGYDSAGPLRLPCSVDEFLRLRALVDREMAHSHSSSHRVHAGGHQQHGYSFAPCTPRQSHLLIDPYPSSSPG

SEQ ID NO: 20137 - protein, 214 aa, Staphylococcus aureus subsp. aureus Mu50
MTKLYPSLLSVDFLDLQHELKRLEEAGVDGVHFDVMDGQFVPNISIGLPILDAVRKGTTLPIDVHLMIENPEKYIASFAEHGADMISIHVESTPHIHRAIQMIKHLDKKAGVVINPGTPISQIEPILDIVDYVLVMTVNPGFGGQSFIDQCVEKIAGLNAIKMERQLNFDIEVDGGVNTDTAKVCVENGATMLVTGSFFFKQEDYKKVTQALKG

SEQ ID NO: 20138 - protein, 383 aa, Zea mays
EFSGLRSSASLPMRRNATSDDFMSAVSFRTHAVGTSGGPRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 20139 - protein, 501 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAGVAVGARRHRVGDLLLRHRPGRAVRQVQDERLRPGPGAGSHGQVPAGQERHHRAPGLAMGPMEPHRSLLVQCTCVMRACSHSWTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 20140 - protein, 279 aa, Arabidopsis thaliana
QNLKPGSSKWDEVTADVLKALEDYGCFEASFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 20141 - protein, 831 aa, Vibrio vulnificus CMCP6
MHFDSGLLALLFVIIALFIGALVRHLLKGSQVPYTVALLILGIAIGLAHRGNAFTDNYTLIGETLSLASEIDPHLFLFLFLPTLIFESAFAMEVHLFRRMFTQIVILAVPGLMLAIWLTAELVAWVLPEHWQWSWALCLMFGALISATDPVAVVALLKEVSSRKRLETLIEGESLLNDGTAIVFFSLFYGWVLMEFSNPGEAITAPPWQAVAQFFVVVFVGLAVGLILGGLCILWIDRVFNDPMIEISLTIAAAYSAFFISENFHVSGVVAVVTLAIMFASVGRTRISPEVAGFLHHFWEMMAHMANTLIFLLVGILVAIRVPLDDKEAWLALFVLYLGIMAIRACSITVFMPILKRIGIGITYEKAVVLCWGGLRGAVSLALAMTVASSDIIPKQIGDHVLFLCAGIVVLTILFNGSTMGHVLKWLNLSSLPPGKQATVDKAQHEVNRVLHDMLPTMMTSDFLKGADWETVKQGAKLQVLKECNSPTEITQDELHTAYLRRLLETERKHYWTQFSQGLIGKQATNKLVEAVEHALDGDPIIGPRNELFTTWRLPDWVEPLRQYNSWNKLLLKVYFRRLALGYDVARGFIQAQEALESHIDTLAPDAEIAVMVRQQVELNKRLTFERIESLRMSFPEIIQALQSQAATRLLLNRERAVINDQLKQAVLDKPEAQKLLNMVEERMAALQKESIFDKSQEQKLINDIPWARELKSKTREELTSWIEHTVYDAGQLICENQRPLNRIGIVSRGSITELYETRSDDNLEKVRTTIGPGETFALISLLTGKTNAQYVSDTPTDIMWLPVDKLKLLMNQDPNLTAVVCQLFKQLKSV

SEQ ID NO: 20142 - protein, 390 aa, Oryza sativa
MAFAASHTASPSSCGGVAQRRSNGMSPVVAMASTINRVKTAKKPYTPPREVHLQVKHSLPPQKREIFDSLQPWAKENLLNLLKPVEKSWQPQDFLPDPSSDGFYDEVKELRERAKEIPDDYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFISHGNTARHAKEYGDLKLAQICGTIAADEKRHETAYTKIVEKLFEIDPDYTVLAFADMMRNKISMTAHLMYDGKDDNLFEHLSAVAQRLGVYTVRDYADMLEFLVQRWKVADLTGLSGEGRRAQDFVCTLAPRIRRLDERAQARAKQAPVIPFSWVYDRKVQL

SEQ ID NO: 20143 - protein, 682 aa, Zea mays
PILPSYTYTVGTPSNQRRGDDDCAASAFLPYRNRTNQSIIPLCSRRPSASKQGTDAAGMGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGQDSLPWILARHEIPWLDVVVDPCASFLVFVVTGLLCVGIKESSFVQGVVTVLNCFVMLFVIIAGSYIGFQTGWVGYKVAGGFFPYGANGMLAGSATVFFAYIGFDSVASTAEEVKNPQRDLPLGIGTALSICCSLYMLVSVVIVGLVPYFAMDPDTPISSAFAKHGMHWAMYLVTTGAVLALCSTLMGSILPQPRILMAMARDGLLPSFFSDVHKTTQVPVKSTVVTGICAAALAFFMDVSQLAGMVSVGTLLAFTIVAVSILILRYVPPDEVPLPSSLQASFRLSQENDEEKLRGTLGDDDHEQGSAEISDVVVEPITDPLIEKQLYASNLSEAKRRKTAACSITSVCIGVLILTTSASATFLPFPVRCSVCVLGGMLLLAGLGMLCWIDQDDGRHSFGHSGGFICPFVPLLPVMCILINTYLLINLGGGTWMRVGVWLVMGVFVYIFYGRTHSSLTDVVYVPVAEANEIYGSSSSLGFVA

SEQ ID NO: 20144 - protein, 256 aa, Brassica oleracea
MGRGRVQLKRIENKINRQVTFSKRRAGLFKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRSRKNQLMYDSVNELQRKEKAIQEQNSMLSKQIKEREKVLMAQQEQWDQQNHGQNMPSPPPPQQHQIQHPYMLSHQPSPFLNMGGLYQEEDPMAMRRNDLDLSLEPVYNCNLGCFAA

SEQ ID NO: 20145 - protein, 579 aa, ASPERGILLUS NIDULANS FGSC A4
MPFGINPFSKNDKHEYPGVVVPLSSAPANSKTSPDPEKKVGPQDTDAGSLDRSSSAENGVGSMHSHQQSQNGHLTLEILRAEVENDLVASGQDSAYDRKSKIINRAIQDIGMGRYQWELFCLCGFGWLADNLWLQGVALTLPQLSLEFGVDENNVRFTTCSLFLGLCLGASFWGIASDIIGRRPAFNFTLLISGAFGLASGGGPNWVGTCALYACLGLGVGGNLPVDGALFLEFLPFASGNLLTMLSVWWPVGNLIASLLAWAFIPNYTCSGDGPCRKEDNMGWRYLVLTLGALTFVMFVCRFFLFHLYESPKFLLSRGRQDEAVAAVQGIAYKNRTTTWLTVDVLNEIGGHPEQQTREKLSTKEIIQRYMSKFSLERIRGLFATKRLGVTTVILWFCWTTIGMGYPLFNAFLPQYLQRAGGGQSQSTDIVYRNYAITSIVGLPGSVLACFTVDIKYIGRKGTMIAGTLITGVLLFCFTASTDPDIQLVCSSLEAFFQNIMYGVLYAYTPEVFPAPNRGTGSGISSCLNRIAGLCAPIVAIYGASANPDAPIYASGALILAAFVAMIFLPIETRGRQTL

SEQ ID NO: 20146 - protein, 195 aa, Glycine max
  unsure (1)..(195): unsure at all Xaa locations
RKAKIFHYGSISLITEPCQSAHIAAAKDAGVVLSYDPNLRLPLWPSADSAREGILSIWETADIIKISEDEISFLTKGEDPYDDAVVHKLFHPNLKLLLVTKGAEXGCRYYTKEFSGRVKGLKVDAVDTTGAGDAFVAGILSQLAVDLSILQKEDELRDSLKFANVCGALTVTERGAIPALPTKEAVLNAMLKPVS

SEQ ID NO: 20147 - protein, 110 aa, Oryza sativa (japonica cultivar-group)
MFGRSGITAAVKVEEEDDGKTPAAKRAGEYVTLKVQDTDGRAVYRTMRWTEQLQGLMDFYYDRAHGRVQRGTGRFLYDGRRLSGWQTPAELDMEDGDEVDFFEELIGGAA

SEQ ID NO: 20148 - protein, 433 aa, Haemophilus somnus 129PT
MAKIVKVIGREIIDSRGNPTVEAEVHLEGGFVGLAAAPSGASTGSREALELRDGDKARFLGKGVLKAVSAVNNEIATALVGKEASNQAEIDQIMIELDGTENKSKFGANAILAVSLANAKAAAASKGMPLYAWIAELNGTPGVYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEGLCKEYPIVSIEDGQDESDWDGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEKAPFLGLKAVKGQA

SEQ ID NO: 20149 - protein, 473 aa, Griffithsia pacifica
YESGVIPYAKMGYWDPDYAIKDTDILALFRVTPQPGVDPVEASAAVAGESSTATWTVVWTDLLTACDLYRAKAYKVEAVPNSSDQYFAYIAYDIDLFEEGSIANLTASIIGNVFGFKAVKALRLEDMRIPVAYLKTFQGPATGVIVERERMDTFGRPFLGATVKPKLGLSGKNYGRVVYEGLKGGLDFLKDDENINSQPFMRWKERFLYSMEAVNRAIAATGEVKGHYMNVTAATMEDMYERAEFAKQLGTVIIMIDLVIGYTAIQTMGIWARKNDMILHLHRAGNSTYSRQKVHGMNFRVICKWMRMAGVDHIHAGTVVGKLEGDPLMIKGFYDTLLLSHLDINLPQGIFFQQDWASLRKVTPVASGGIHCGQMHQLVDYLGEDVVLQFGGGTIGHPDGIQAGATANRVALESMIIARNEGRDYVAEGPQILRDAAKTCGPLQTALDLWKDITFNYTSTDTADFVETPTANV

SEQ ID NO: 20150 - protein, 657 aa, Saccharomyces cerevisiae
MSIRDLYHARASPFISLEFFPPKTELGTRNLMERMHRMTALDPLFITVTWGAGGTTAEKTLTLASLAQQTLNIPVCMHLTCTNTEKAIIDDALDRCYNAGIRNILALRGDPPIGEDWLDSQSNESPFKYAVDLVRYIKQSYGDKFCVGVAAYPEGHCEGEAEGHEQDPLKDLVYLKEKVEAGADFVITQLFYDVEKFLTFEMLFRERISQDLPLFPGLMPINSYLLFHRAAKLSHASIPPAILSRFPPEIQSDDNAVKSIGVDILIELIQEIYQRTSGRIKGFHFYTLNLEKAIAQIVSQSPVLSHIVNESSEEEGEDETSGEIGSIENVPIEDADGDIVLDDSNEETVANRKRRRHSSLDSAKLIFNRAIVTEKGLRYNNENGSMPSKKALISISKGHGTLGRDATWDEFPNGRFGDSRSPAYGEIDGYGPSIKVSKSKALELWGIPKTIGDLKDIFIKYLEGSTDAIPWSDLGLSAETALIQEELIQLNYRGYLTLASQPATNATLSSDKIFGWGPAKGRLYQKAFVEMFIHRQQWETTLKPKLDHYGRRKFSYYAGDSSGSFETNLDPHSSSVVTWGVFPNSPVKQTTIIEEESFKAWRDEAFSIWSEWAKLFPRNTPANILLRLVHKDYCLVSIVHHDFKETDELWEMLLDQA

SEQ ID NO: 20151 - protein, 839 aa, Yersinia pestis KIM
MLALVIVGARHCRLVVAIKLGKNVMTSPFSYTSPVVSVDALKHSIAYKLMFIIGKDPTIATQHDWLNATLFAVRDRMVERWLRSNRAQLSQDVRQVYYLSMEFLLGRTLSNALLSMGIYDEIEQALDEMGLSLSELLKEENDPGLGNGGLGRLAACFLDSLATLALPGRGYGIRYEYGMFSQKIVNGQQMESPDNWLEYGNAWEFPRHNTRYKVRFGGRIQQEGSKIRWLETEEILACAYDQIIPGFDTDATNTLRLWSAQASNEINLGKFNQGDYFAAVEDKNHSENVSRVLYPDDSTYSGRELRLRQEYFLVSATVQDILNRHWAMHHTFNNLADKIAIHLNDTHPVLSIPEMMRLLIDEHKFTWMDAWDVVQQVFSYTNHTLMSEALETWPVDMIGKILPRHLQIIFDINDHFLKLVEEQYPDDKELLSRVSVIDENNGRRIRMAWLAVIASHKVNGVSALHSELMVQSLFADFARIFPNRFCNKTNGVTPRRWLGLANRPLAAVLDDSIGQTWRTDLSQLSELEKNLDYPSFLLALQKAKLENKKRLAVYIAEKLNIVVNPAALFDVQIKRIHEYKRQLLNVLHVITRYNRIIDAPDNNWVPRVVIFAGKAASAYYNAKQIIHLINDVAKVINNDPRINNLLKVVFIPNYSVSLAQLIIPAADLSEQISLAGTEASGTSNMKFALNGALTIGTLDGANVEIREHVGEENIFIFGNTTEQVEALRKSGYNPRKYYDEDPELHQVLTQIATGTFSPEEPHRYTNLFDSLVNLGDHYQLLADYRSYVDTQEQVDALYRNRDEWSRKTLLNIANMGYFSSDRTIKEYADEIWHIKPIRL

SEQ ID NO: 20152 - protein, 220 aa, Dendrobium sp. XMW-2002-10
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHIRRKLLNRGIDPATHRPVSTATASNLTMSFSSGSSVKDKRTSSSSSSSRVGRISALLPRCPDLNLDLCISPSLEEQMPQDLLVEESNCGGEFLRLGSSFLLDYRSLEMK

SEQ ID NO: 20153 - protein, 98 aa, Salmonella enterica
SEQALYYIGGVIKHAKAINALANPTTNSYKRLVPGYEAPVMLAYSARNRSASIRIPVVASPKARRIEVRFPDPAANPYLCFAALLMAGLDGIKNKIHP

SEQ ID NO: 20154 - protein, 488 aa, Mastocarpus papillatus
MSNSVEERTRIKNERYESGVIPYANMGYWDPDYVVKETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYAMEGVNRSVAASGEIKGHYLNITAATMEEMYERAEFAKQLGSIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADFVETPTANV

SEQ ID NO: 20155 - protein, 575 aa, Zea mays
MPPPTWGLPLAGAAYQPYVSELLSFSIERLHKEPELLRVDAERVRRQMQEVAVENYAAFIAASEALSFVRAQLESFDGHLEAMIEEIPNLTSGCTEFVESAQQILEERKLNQTLLANHTTLLDLLEIPQLMDTCIRNGNYDEALDLEAFVSKIWKLHPDLPVVQGLATEVKKTVQSLVSQLLQKLRSNIQLPECLRIVAHLRRIGVFSESELRLQFLRCREAWLSGILEDLDQRNVYDYLKGMVTCHRVHLFDVVNQYRAIFNNDKSGNDENYDGGLLFSWAMQQVSNHLTTLQVMLPNITEGGSLSNILEQCMYCAMGLGLVGLDFRGLLPPIFENAVLNLFSKNMSTAVENFQVILDSHCWVPMPSVGFVANGVVDETSDDVTPPSVLMEHPPLAVFVNGVSAAMNELRPCAPLSLKVVLAQEVVKGLHAVSDSLVRYKAMRMLRGNESALFLSLCQAFIEVAYPYCAACFGRCYPDGATLISECQGTFDAVRQLLTVPARSNSSSIERRQSGGIERRQSGAIERKQSVESTGTAVTDNGLSADGPGLETNSSAATTTSPVDDGGSTHPPASK

SEQ ID NO: 20156 - protein, 446 aa, Zea mays; identical to SEQ ID NO: 3277

SEQ ID NO: 20157 - protein, 160 aa, Medicago sativa
MDFRLMGLMLQCYTALHQMMDLSDENVEKSSSHNAPTRSYVRDAKAMAATPADVKENPNSYVFVIDMPGLKSGDIKVQVEDDNVLVISGERKREEEKEGGAKYLRMERRVGKFMRKFVLPENPNTDAVSPVCQDGVLTVTVQKLPPPRPKKPRTIEVQIA

SEQ ID NO: 20158 - protein, 340 aa, Oryza sativa
MGILSLITGKAGASGFGSGSTAEQVTAGVDATGLTVIVTGGASGIGLETSRVFAMRGAHVIIAARNTEAASVVRKKIIEENPKAHIDVLKLDLSSLKSVRAFADQFNSMNLPLNILMYKFQLIKGSHIFFFFPSCRNNAGVMFCPFGLSEDGVEMQFATNHLGHFLLTNLLLDNMKATAKSTGIEGRIVNLSSVAHLHTYPKGIEFDKLNDEKTYDDKMAYGQSKLANILHAKELSRRLKEEGANITINCVHPGLIMTNLMRHSFFLMRVLQFATYILWKSVPQGAATTCYVGLNPQLKGVTGQYFADCNVEKTSRFARNDALAKQLWEFSEKLIKSSSK

SEQ ID NO: 20159 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 20160 - protein, 419 aa, Oryza sativa
MAFDAFTDKNAVFRRLKAKPENKSQISCTSIVVCLLISQMCFDCSAKNPTWASVTYGIFLCLDCSAVHRSLGVHITFVRSTNLDSWTPDQLKMMAFGGNNRAHAFFKQHGWTDGGKVDAKYTSRAAELYRQILQKEVAKSSADNVLPSSPVAASQPQNPSDDFPEFKLPEAPAENTNGKQEPDVTNSQKAPTQTPKAPTHPTFATSVKKSIGAKKIGGKTGGLGVKKLTTKPSESLYDQKPEEPKPAAPVMTTSTTKSGPSLHSRFEYVENEPAVDSRNGGTQMTGHVAPPKSSNFFQEYGMDNGFQKKTSTAATKTQIQETDEARKKFSNAKAISSSQFFGNQSREEKDAQMSLQKFAGSSSISSADLFGRRDMDDSNLDLSAADLINRISFQNMAGETGKKLTSIASNFISDLDRIL

SEQ ID NO: 20161 - protein, 752 aa, Eremothecium gossypii
MSYQPVGPRQEAEHQAEVRNFDQFTTIDWILEEKSQRNSGARDVGYSGRWRRYLEEVWHRGQAFFTLTAIGVTVGCIAGFIQVLTETLVNWKTGYCARNWLLNKSFCCQRIAEDTRKFLVIEGAQCVEERLWVPWSNSVLAYFTFITLSVAFAMLSALMVKCLAPMATGSGISEIKVHVSGFQYKKEFFSLTTLAVKSVALPLAISSGLSVGKEGPSVHYATCCGFLIVQFLLRNTLKYAEQAEYLVASSAAGVAVAFGAPIGGVLFGLEEMSSSPHFNLSTLWKSFYVALSAVSTLQYLDPFRNGKIVLFEVKYDRDWHVEEIPIFILLGIFGGLYGHYIGNLNIWFVTFRRNYLSKWPLREVFVLALATTCLSYFNEFLKLDMTESMSLLFHECVEEKSGMNFEHRLCQLDGKFSFLSFLTLYCSLMFATVVRALGVVVSYGARVPAGIFVPSMAVGATFGRSISVLVENFITGPHVITPGTYAFLGAAAALSGITNMTPTVVVIMIELTGAFIYIIPTMIVVAIPRIVYSSFSKEGGIAEKMIMVNGFPFMECPQEHRDFLDEYCAADISTTDVVTIKESMHLSDLESLLEEVGNSYKGFPIIRNDDENEQEKRCIGYVTLQHIRSQLGMYTNDNTARNTVVDFTKKFLPDDENLIQFSDLVNYTPFTVDKSLSLSLLYQMFHKLGCKVVIVEDAGFLVGIITKKDFLRFQRTKRTELYGSINTFDEQSAERLWNLIMRVIRKLRSKQL

SEQ ID NO: 20162 - protein, 259 aa, Vitis vinifera
WVEEHRQNRLSANDNGAEQDFIHAMLSVIDDGQFSGHDPDTIIKGTCSNLILAGNDTTSITLTWALSLLLNNRHALKKAQAELEIHVGKHRQVDGSDIKNLVYLQAIVKETLRLYPPGPLSLPHEAMEDCTVAGFHIQAGTRLLVNLWKLHRDPRVWLDPLEFQPERFLTKHAGLDVRGKNYELLPFGSGRRVCPGISFALELTHLTLARLLHGFELGAVADSPVDMTESPGLTAPKATPLEVTIVPRLPFELYSYEAA

SEQ ID NO: 20163 - protein, 172 aa, Staphylococcus aureus subsp. aureus
MDLKQYVSEVQDWPKPGVSFKDITTIMDNGEAYGYATDKIVEYAKDRDVDIVVGPEARGFIIGCPVAYSMGIGFAPFRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 20164 - protein, 196 aa, Oryza sativa
MASLRRALDEFSSLQADDGHWPGDFSGVMFIMPGLIFALYVTGSLDTIISPEHRREICRYIYNHQNEDGGWGSLMLSSSTMFGTCSNYITLRLLGEETSNEQLAKGRIWIILHGGTTFVPQWGKIWLSILGVYEWAGNNPIFPELWLTPQFLPFHPGKFWCLTRMVYLPMAYLYGKKFVGPTAPTILALREEIYSA

SEQ ID NO: 20165 - protein, 181 aa, Glycine max
  unsure (1)..(181): unsure at all Xaa locations
MATIVSIKARQIFDSRGNPTVEXAVPSGASTGIYEALELRDGGSDYLGKGVSKAVDNVNTVIGPALIGKDPTEQTAIDNLMVQQLDGTVNEWGWCKQKLGANAILAVSLAVCKAGASGLKMPLYKHIANIAGNKSLVCCSAFKVXNGGSHAGTNLCSYGLPGELVKEPEGEVTVWLKNAIL

SEQ ID NO: 20166 - protein, 424 aa, Zea mays
MGFDKEASSSSSRLDAAPLLPQHGGGAGGHLSSQPKTFANVFIAVVGSGVLGLPYTFSRTGWAAGTLLLLAVAALTFHCMMLLVAARRRIADAHPKIASFGDLGHAIYGAPGRHAVDAMLVLSQASFCVGYLIFISNTMAHLYPIAIGAQSPASPLLTAKALFIWAMLPFQLGLNSIRTLTLLAPLSIFADVVDLGAMGVVLGQDASVWLADRPPVFAFAGPAQLLYGLGVAVYAFEGIGMVLPLEAEAADKRRFGATLALSMAFIAVMYGLFGAMGYLAFGAATRDIITTNLGTGWLSVLVQLGLCINLFFTMPVMMNPVYEVAERLLCGKRYAWWLRWILVVLVGLLAMLVPNFADFLSLVGSSVCVVLGFVLPAVFHLKVFGTEIGWAGLVADVAVIVIGIALAVSGTWTSLVQIFSSSDL

SEQ ID NO: 20167 - protein, 357 aa, Streptococcus mutans UA159
MPNYKDLPQELTRTRTNEAVSELVDLKVHTATDIEAQEVSKEQAKDMYKTMWDIRNFEENARRFFAAGQIPGFVHLYAGEEAVAAGVCANLTDKDYITSTHRGHGHCVAKGGDLKGMMAEIFGKETGLGKGKGGSMHIADLDKGILGANGMVGGGFGLATGAAMRNKYLKTDDVAVCFFGDGAANEGLFHECLNMASIWKLPVIFVNENNLFAESTPQWYSSASATIAERALAYDMPGVRVNGKDLFAVYQVAKEAVERARSGQGPTLIEAVTYRDHGHFEGDEQKYKAPDGEEKDWADVDPLEVFRNYTIEHELLTEEELDEILEESKKDVDDAIKYAQDSPIPKAESLLEDVFAE

SEQ ID NO: 20168 - protein, 489 aa, Citrus unshiu
MWGRQREASMMYKRTSSRDRSSTFDVEETTALVQNGTEVENTNPSWKLSFPHVLVATLSSFLFGYHLGVVNEPLESISLDLGFNGNTLAEGLVVSMCLGGAFIGSTLSGWIADGVGRRRAFQLCALPMIIGASISATTRNLIGMLLGRFVVGTGMGLGPTVAALYVTEVSPPFVRGTYGAFIQIATCLGLMGSLLIGIPVKEIAGWWRICFWVSIVPAAILCLAMVFCAESPHWLYKKGRTAEAEAEFEKLLGGSHVKSSLAELSKLDRGDDGDIVKFEELLYGRHFRVVFIGSTLFALQQLSGINAIFYFSSSVFKSAGLSSGLANVFVGIANLLGSVVAMVLMDKLGRKALLQWSFFSMAVSMAIQVAASSSYIPGSASLYLSVGGMLMFVLTFALGAGPVPSLLLPEIFPSRIRAKAMAVCMSVHWVINFFVGLLFLRLLEQLGPQLLYSIFGTFCLMAVAFVKRNVVETKGKSLQEIEIALLPQE

SEQ ID NO: 20169 - protein, 580 aa, GIBBERELLA ZEAE PH-1
MAPPSMTVYFDDQNPNSEKGKEAGARRSLAGLDYSPLPRITGRSFLLATFVSMGGLLFGYDTGQISGFLEMPDFLDRFAQTNSNGEKEFSTVRSGLIVALLSIGTLIGALVAAPISDRIGRKYSISGWTWVIAIGFIIQISSNRDWVQIMMGRWVAGLGVGALSLLVPMFQAETAPPWIRGAMVCCYQLFITMGIFLAACFNYGTVTHQRNNSASWRIVIGIGWVFTLILGIGILFLPDTPRFDYRKGKIDRARDTLCKVYGATPNHWAIHTQMEEIESKLRAESQIKGNPAKEFVQMFKAPRMTYRILLGMGLQMFQQLTGANYFFYYGTTIFASVSIDSYKTQIILNTINFLVTFIGLYIVEHYGRRKSLIAGSTWMFICFLIFASVGHFSLDRANPSSTQGAGVAMIVFACLFILGFATTWGPMIWTIMAEIFPSRYRAKGMALATASNWLWNFLLAFFTPFITKDIDFRYGYVFAGCNVLGGLIVYFFVIEGQGRTLEEIDTMYLERVSPMKSSKWIPPPPEEMSRIRKEAGTDIETAAAAHHGSSDDETLARRSGVTDGGHGQRKEENAGATHRE

SEQ ID NO: 20170 - protein, 252 aa, Geobacillus stearothermophilus
RKPIIAGNWKMNGTLAEAVQFVEDVKGHVPPADEVISVVCAPFLFLDRLVQAADGTDLKIGAQTMHFADQGAYTGEVSPVMLKDLGVTYVILGHSERRQMFAETDETVNKKVLAAFTRGLIPIICCGESLEEREAGQTNAVVASQVEKALAGLTPEQVKQAVIAYEPIWAIGTGKSSTPEDANSVCGHIRSVVSRLFGPEAAEAIRIQYGGSVKPDNIRDFLAQQQIDGALVGGASLEPASFLQLVEAGRHE

SEQ ID NO: 20171 - protein, 353 aa, Colletotrichum trifolii
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEAVWKDRGVQDCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 20172 - protein, 470 aa, Gelidium crinale
  unsure (1)..(470): unsure at all Xaa locations
GVIPYAKMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAXXXXXXXXXXXXXXXXXXXXXXXXXXXXXXXXXXXXVICKWMRMAGVDHIHAGTVVGKLEGDPLMIKGFYNTLLLTHLDVNLPQGIFLEQDWASLRKVTPVASGGIHCGQMHQLLDYLGIDVVLQFGGGTIGHPDGIQAGATANRVALEAMVIARNEGRDYVAEGPQILRDAAKTCGPLQTALDLWKDITFNYASTDTADFVETPTANV

SEQ ID NO: 20173 - protein, 187 aa, Hordeum vulgare subsp. vulgare
KYPYIAGMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDALLMGADYYETEADKKLLAEKGGIPIGIGKNSHIKRAIIDKNARIG

SEQ ID NO: 20174 - protein, 362 aa, Saccharum hybrid cultivar
MGSTAEDVAAVADEEACMYAMQLASASILPMTLKNALELGLLEVLQAEAPAGKALAPEEVVARLPVAPTNPDAADMVDRMLRLLASYDVVKCQMEDKDGKYERRYSAAPVGKWLTPNEDGVSMAALTLMNQDKVLMESWYYLKDAVLDGGIPFNKAYGMTAFEYHGTDPRFNRVFNEGMKNHSVIITKKLLEFYTGFEGVSTLVDVGGGIGATLHAITSHHPQIKGINFDLPHVISEAPPFPGVQHVGGDMFKSVPAGDAILMKWILHDWSDAHCATLLKNCYDALPENGKVIVVECVLPVNTEAVPKAQGVFHVDMIMLAHNPGGRERYEREFHDLAKGAGFSGFKATYIYANAWAIEFIK

SEQ ID NO: 20175 - protein, 294 aa, Escherichia fergusonii
IVFRAAQKRSDIEIVAINDLLDADYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYAGQDIVSNASCTTNCLAPLAKVINDNFGMIEGLMTTVHATTATQKTVDGPSHKDWRGGRGASQNIIPSSTGAAKAVGKVLPELNGKLTGMAFRVPTPNVSVVDLTVRLEKPATYEQIKAAVKAAAEGEMKGVLGYTEDDVVSTDFNGEVCTSVFDAKAGIALNDNFVKLV

SEQ ID NO: 20176 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 20177 - protein, 256 aa, Pantoea agglomerans
  unsure (1)..(256): unsure at all Xaa locations
GAAGGIGQALALLLKXQLPAGXELSLYDIAPVTPGVAVDLSHIPTAVAIQGFSGEDATPALQGADVVLISAGVARKPGMDRADLFNVNAGIVRNLIEQVATTAPKALIGVITNPVNTTVAIAAEVLKKHGAYDKNRLFGVTTLDIIRANTFVAALKGKQPDQVEVPVIGGHSGVTILPVXSQVKGVSFSDQEVADLTKRIQNAGTEVVEAKAGGGSATLSMGQAAARFGLSLVRALKGEANVVECAYVEGEGEHAR

SEQ ID NO: 20178 - protein, 467 aa, Pseudomonas putida
MQQAQGLKRGLNARHIRFMALGSAIGTGLFYGSASAIQMAGPAVLLAYLIGGAAVFMVMRALGEMAVHNPVAGSFGHYASTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGVSNLFDHGGFMPNGVGGLIASFAVVMFAFGGIEIIGVTAGEAKDPQRVIPKAINAVPLRILLFYVLTLFVLMCLYPWPQIGSEGSPFVQIFSNLGIGSAAAVLNVVVISAAISAINSDIFGAGRMMYGLAHQGHAPRSFGKLSKHGVPWMTVVVMGAALLIGVLLNYLIPENVFLLIASIATFATVWVWLMILLTQVAMRRSMSREEVAQLKFPVPFWPYGPAMAIAFMVFIFGVLGYFPDTQAALIVGVIWVVFLVASYLLWCKPRAGQGQPVAEPVELHR

SEQ ID NO: 20179 - protein, 312 aa, Escherichia coli
MKVAVLGAAGGIGQALALLLKTQLPSGSELSLYDIAPVTPGVAVDLSHIPTAVKIKGFSGEDATPALEGADVVLISAGVRRKPGMDRSDLFNVNAGIVKNLVQQVAKTCPKACIGIITNPVNTTVAIAAEVLKKAGVYDKNKLLGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGQEFVNK

SEQ ID NO: 20180 - protein, 564 aa, Saccharomyces kluyveri
MSEITLGLYLFERLNQVDVKTIFGLPGDFNLSLLDKIYEVPGMRWAGNANELNAAYAADGYARVKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNSVLELIKDAKNPIILADACASRHDVKPETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLRPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQD

SEQ ID NO: 20181 - protein, 235 aa, Zea mays; identical to SEQ ID NO: 17302

SEQ ID NO: 20182 - protein, 293 aa, Bradyrhizobium japonicum USDA 110
MTKAKTRLAYMGAGVAVVIWGATPAATAIVARELSPGLIGLARLLLSATILIPIAVSLKPELPSDRGGWIALLISALVGFAGSFVLQGVGIARTSTSHAALVLALAPIFTATVHFLLSRCWPRPLWWLGSAIALMGVAILIPGRNPAGSVAAPTLFGDLLVLAGTVTVSVGYVAGARLSARIGLFAATCWSLLLAGLITLPAFPALASALGQLSFAVWGALGFLAVFCTLIGFAVWFWALEHGGVTSIAPLQFGQPLVSLVIAVAFLSEDIFPATLLALSLVILGVHLSRRAA

SEQ ID NO: 20183 - protein, 82 aa, Zea mays
  unsure (1)..(82): unsure at all Xaa locations
MSVACKEDKKPAEGGAYINLKVKGQDANEVFFGLKRSTQLKMLMNAYWDRQFVNMNAIAFLLDGRPPCXKNTPDNLEMEDGN

SEQ ID NO: 20184 - protein, 487 aa, Rhizobium sp. NGR234
MTLSFDPDSLPLPVGHFIGDRLLPAEGFIDMHRPSDGKAYAGCPIADEALVDQAVETAKKALKASNWGGLRPRERTVALQRWADLIESEAETLAKLEALSSTRPVGHLVAGDIAVSAEQIRFFAEFADKEGSDLVPTDDSNLGMIMTEPYGVVAAITPWNFPVSMAAWKLGPALAAGNAVVLKPSEMTPFSTVYLAELAIRAGMPAGLINIVLGDGTVTGTAITGHPDIAKVSFTGSTGAGAAIMANIARTGVKPMTLELGGKSPQLVFADADLDKAAAAIAQSMLSNAGQACVAGSRLIVEESVAAPLAEAIVTRMKAAKPGPTWDEATEYSPIISKRQLNRIHGIVEAAVAAGGECLFGGKQMDAPGYFYQPTLMAVRDSSSPAITEEIFGPVLTMQTFADEEEALALADHPTYGLAAGLFTRDLSRALRLTRRLQAGTVWVNRYSRSRDHILPTGGYKRSGIGKDLGREAYHANRKSKSVLISL

SEQ ID NO: 20185 - protein, 369 aa, Chlamydomonas sp. W80
MSGKAVHARQASRARKGAPIRMESDASEKKLKVAINGFGRHRPSFLPRLGGPQQSRLLDAGSAINDSGGVKQASHLLKYDSILGTFDAEVKIVDDSHISVQRQVRIQIVSSRDPLQLPWKALDIDLVIEGTGVFIDTKGAGKHIEAGAKKVLITAPAKGDGIPTFVCGVNADDYKHEYPIISNASCTTNCMAPFVKVLEEKFGIIKGTMTTTHSYTGDQRLLDASHRDLRRARAAAMNIVPTSTGAAKAVALVLPSMKGKLNGIALRVPTPNVSIVDLVVQVEKKTFAEEVNAAFREAANGAQKGVLAVSDEPLVSVDFRCSDVSSTIDASLTMVMGDDMVKVVAWYDNEWGYSQRVVDLAEITAQKWE

SEQ ID NO: 20186 - protein, 201 aa, Aspergillus awamori
MNPEYDYLFKLLLIGDSGVGKSCLLLRFADDTYTESYISTIGVDFKIRTIELDGKTMKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 20187 - protein, 426 aa, Glycine max
  unsure (1)..(426): unsure at all Xaa locations
MVRENAVMGGASEERGVRVTRAMARAVLGGVSASSRPSFKKQHKNNKGFGRVALADVTNISKKGCATSKSQARGSYKKTNTKGASNVSIQVLSTHXVRDVRAKLAKDLPSISGVESHDANVAERQEGTEVVQPSMSVMAGPLLSMQDSMKSDEILRSPNKDGLDIVDIDSVELKDPQVWSSYAPDIYNSIFVREFERRPSSDYMDMLQQDITPSMRRILIDWLVEVSEEYKLLPDTLYLTVNLIDRSLSQSLVQKQRLQLLGVTCMLIASKYEEICAPRVEEFCFITDNTYTKAEVLKMESEVLNLLHFQLSVPTTKTFLRRFILASQSSYKXFLQFLPSLIAASAVLLARWTLNQSEHPWNSTMEHYTNYKVSELKTTVLALADLQHDMKGCSLNSIREKYKQQKFRSVANLSPKPVQSLFKAQV

SEQ ID NO: 20188 - protein, 239 aa, Triticum aestivum
MAPAPTTPSFLRPPPLQPHRIRLPAPPPSASFRLSEILGGRGLCNGEVGIRKELSSPTPPSPPPSTPSGDSSPGSAESDPPAVDPDAFEKEMMGLTGGFPGGEVGLKDFVAKNPPPPPKRTQTDGKASSAVVPAGRPRPPELPLFLPGMVVLVKNPNNAYHMYCGIVQRVTDGKVGVLFEGGNWDRLITFGVDELEGREKGPPMVNPKSVVLEALVEAMDEDEVAEKKKEEEGTAAIKA

SEQ ID NO: 20189 - protein, 313 aa, Escherichia coli
MKVAVLGAAGGIGQALALLLKTQLPSGSELSLYDIAPVTPGVAVDLSHIPTAVKIKGFSGEDATPALEGRDVVLISAGVRRKPGMDRSDLFNVNAGIVKNLVQQVAKTCPKACIGNITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIAWAKSSLISN

SEQ ID NO: 20190 - protein, 260 aa, Dechloromonas sp. RCB
MTLRVFITGASSGIGEALAVYYAAQGARLGLVARRNEFLEALNQRLGGQHACYTLDVSDAPALHAAAADFLARFGAPDIIIANAGVSAGTLTECEEDLAVFRRVMDTNVFGMAATFAPFIPAMKAAASGGRKTQRLVGIASVAGIRGLPGAEAYSASKAAAITYLESLRLEMRPYGIKVVTIAPGYIETPMTAVNPYQMPFLLPVDQAAERFAATIERGTSYAVIPWQMGVVAKLLRVLPNWLYDRLFTSAPRKPRGLLK

SEQ ID NO: 20191 - protein, 474 aa, Thermobifida fusca
MFSNADEALAYIRTEGVQFVDVRFTDLFGGVHHVTLPAEKVDEDFLTNGQMFDGSSIRGFQAIHESDMLLLPDLSTAVLDPFREYKTLNITFFVHDPLTRESYSRDPRNVARKAEAYLKSTGIADTAYFGPEAEFYIFDDVQFATAPNTGFYAIDSVEGAWNTGSKREGGNLGYRPRYKGGYFPVEPSDHYSDLRSRMVRTMIEVGLPVELHHHEVGTAGQSEIGIKFGTLLQQADRVQLYKYIVKNVANAAGKTVTFMPKPLFGDNGSGMHCHQSLWKDGAPLFFDENGYAQLSDIARYYIGGLLKHAPSLLAFTNPTINSYHRLVPGYEAPINLVYSQRNRSACIRIPLTGSDPKAKRLEFRVPDPSANPYLAFSAMLMAGIDGIQNKIEPPEPLDKDLYELPPEEAAEIEKVPASLEEALDHLEEDHEYLVEGGVFTEDLIETYINYKRTVEIDSVRLRPHPREFELYYDV

SEQ ID NO: 20192 - protein, 349 aa, Escherichia coli CFT073
MKIKAVGAYSAKQPLESMDITRREPGPHDVKIEIAYCGVCHSDIHQVRSEWAGTVYPCVPGHEIVGRVVAVGDQVEKHAPGDLVGVGCIVDSCKHCEECEDGLENYCDHMTGTYNSPTPDEPGHTLGGYSQQIVVHERYVLRIRHPQEQLAAVAPLLCAGITTYSPLRHWLAGPGKKVGVVGIGGLGHMGIKLAHAMGAHVVAFTTSESKREAAKALGADEVVNSRNADEMVAHVKSFDFILNTVAAPHNLDDFTTLLKRDGTITLVGAPATPHKSPEVFNLIMKRRAIAGSMIGGIPETQEMLDFCAEHGIVADIEMIRADQINEAYERMLRGDVKYRFVIDNRTLTD

SEQ ID NO: 20193 - protein, 487 aa, Oryza sativa (japonica cultivar-group); identical to SEQ ID NO: 6499

SEQ ID NO: 20194 - protein, 243 aa, Bacillus licheniformis
MSYRVKRMLMLLVTGLFLSLSTFAASASAQTGGSFYEPFNNYNTGLWQKADGYSNGNMFNCTWRANNVSMTSLGEMRLSLTSPSYNKFDCGENRSVQTYGYGLYEVNMKPAKNVGIVSSFFTYTGPTDGTPWDEIDIEFLGKDTTKVQFNYYTNGVGNHEKIVNLGFDAANSYHTYAFDWQPNSIKWYVDGQLKHTATTQIPQTPGKIMMNLWNGAGVDEWLGSYNGVTPLSRSLHWVRYTKR

SEQ ID NO: 20195 - protein, 463 aa, Zea mays
MPQYQELPCGGQELDIDTALKDGILGGALEPVGAAAGDDGKQPVELRRMMDELDAAAGDGGGGGGDEAVPAVFICPISLEPMVDPVTLCTGQTYERANISRWLALGHRTCPTTMQELWDDALTPNATLRQLIAAWFSRRYTRFKKRSADFHGRAADLVGSLRGTAVPRRQPLKGQARVAALRELRTLAAAHQSVTKAIAEAGGVALLTSLLGPFTSHAVGAEAVAILVSGVLLDADTKAALMQPAKVSLVVDMLNEGAADTKINCVRLIRILMVERGFRPETVASLSLLVGVMRLIRDKRHPDGVAAGLELLNSICAVHRPARCMVVSIGAVPQLVELLPELATECVEPALDILDALSAVPEGRMALKDCPRTIPNAVRLLMRVSEACTRRALSMLWTVCRMAPEECAPAAVEAGLAAKLLLVIQSGCAPELKQKASELLKLCRLNYTDTLFISKCKLTRTIQ

SEQ ID NO: 20196 - protein, 363 aa, Buchnera aphidicola (Rhopalosiphum padi)
MKKKFRIAVLPGDGIGPEIMREAYKILNILEKNFSLPLEIREFSVGGIAIDREGIALPEETLRGCENSDAILFGSVGGKKWDYLPIESRPERASLLPLRKHFNLFSNLRPAKLYSDLKNLSPLRSNIVRNGFDILCVRELTGGIYFGKPKGRSKNENGEYSFDTEIYYDFEIKRIAHLAFELASSRRCKVCSIDKSNVLASSILWREIVEEVSKNYPNIILSHLYIDNACMQIIKNPSQFDVLLCSNIFGDIISDECAMITGSIGMLPSASLNSKKFGLYEPAGGSAPDIEGKNIANPIAQILSLSMLIRHSMNLNEIADKIDSSVYRALKAGYRTLDISDGKNYIKTNEMGDIIAKFLINGK

SEQ ID NO: 20197 - protein, 376 aa, Prochlorococcus marinus str. MIT 9313
MTLCQVWAASSSGTAESATYFCMIGGHFPCGFPVFVMTLRVAINGFGRIGRNFMRCWLSRGANTGIDVVGINVTSDPKTNAHLLKYDSILGQIKDAEIGYTDDTFVINGKTIKCFSDRNPLNLPWKEWGIDLVIESTGVFNTDVGASKHIEAGAKKVILTAPGKGDGVGTYVVGVNADQYRHGDFNVLSNASCTTNCLAPIVKVLDQTFGINKGLMTTIHSYTGDQRILDNSHRDLRRARAAAMNIVPTSTGAAKAVALVYPQMKGKLTGIAMRVPTPNVSAVDLVFESGRSTTAEEVNAALKSASQGGMKGIIKYGDLPLVSSDYAGTNESTIVDEDLTMTIGDNLVKVVAWYDNEWGYSQRVVDLAEIVAKNWK

SEQ ID NO: 20198 - protein, 251 aa, Vibrio sp.
MRQALVMGNWKLNATKGSVEALINGLVDAAKDNATVEVAVCPPAVFIPQVEALTADTAITYGAQDCDVNTSGAFTGENSAVMLKEFGCKYTLVGHSERRVIHGESSEVVADKFAVTPENGLVPVLCIGETLEQFEAGETKAVVEAQLQAVVTKSGITSLNNAVIAYEPVWAIGTGKTATPEIAQEIPAHIRSWLAEQDAAVANKVQILYGGSVKPANSAELFGQADIDGGLVGGASLDAVEFSKVISGASA

SEQ ID NO: 20199 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEKNSLEGMLDTL

SEQ ID NO: 20200 - protein, 356 aa, Prunus dulcis
MDLSNEMSSANLLQAQAHIWNCIFSFINPMSLKCAVQLGIPDIIKKHGNPMSLSDLISALPIHPKKSNCVYRLMRILVHSGFFCRQKLSELDEEEGYVLTDASRLLLKDDPLSARPFLLGALDPFMTKPWHYFSTWFQNDDPTACVTAHGTTFWDFGCLEPSLSHIFNDAMASDARLISKVVSNEYKGVFEGLESLVDVGGGIGTMPKAIADVFPHVECIVFDLPHVVADLKGSENLKFFGGDMFEAIPPTDAILMKWILHDWSDEECIKILQRSKEAITRKEKKGKVIIVDMVMKQKGDDQSIETQLFFDMLMMVLFTGKERTEKEWAKLFSDAGFSDYKITPICGLRYLIEVYP

SEQ ID NO: 20201 - protein, 112 aa, Zea mays
SVIEVRNGFTFLDLIVIQIESLNKKYGCNVPLLLMNSVNTHDDTQKIVEKYSNSNIEIHTFNQSQYPRIVTEDFLPLPSKGKSGKDGWYPPGHGDVFPSLNNSGKLDILLAQ

SEQ ID NO: 20202 - protein, 289 aa, Streptomyces griseus
MKGIILAGGHGTRLQPITFGVSKQLLPVYDKPMIYYPLSVLMLAGITDIQIVAAPDGLQGFRRLLGDGSDLGLDLSYAEQDKPRGLADAFLVSEDHIGDDAVALVLGDNLFHGPGFSDILRRVALDLDGAVLFGYPVRDPERYGVGEVDGAGNLTALEEKPARPRSNLAITGLYFYDNDVVEIARSLRPSERGELEITDVNRRYLERGKAALVQLGRGFVWLDTGTHDALIDAGQYVQLLEHRQGVRIACVEEIAWRMGYIDREACHRLGAQLARSPYGQYVMDIAAAG

SEQ ID NO: 20203 - protein, 464 aa, Triticum aestivum
  unsure (1)..(464): unsure at all Xaa locations
AICTGPGLGSSLRLRPSTPAPSPPPPSLLPPSPPLLLFLLHPEEARARARSAWWLARDGDPTPGAADRSSVFRKLRAKSDNKMCFDCNAKNPTWASVTYGVFLCIDXCSAVHRSLGVHVSXFVRSTNLDSWTPXESVKMMVYXGNNRAXAFFKQHGRTEDGKIGGXYTSRRLLTYTEHVATSXSRFLKVPQKSGNNSRPPSXSQLLRCSSQAGAFPEFKLAEVPKDRXRQSLERSLEIRPAGLGGPKKLGAMSEGLGVKKPNTKSNERQYDRKPEEPKPALPTITACXHEVKKVAHPYIARFQYLSQXPSTETKTGGGNKTGHVAAPKXSSDFFHEYGMDNGFQRKTGTAASKTQIEETDEARKKFSNAKASSSSQSFGNTDREQKEAQLSLQKFSGSSSISSADLFGRDTNDSDLDASAADLINRISFQATQDLSSLKNMAGETGKKLTSFVSNFITDLDRIL

SEQ ID NO: 20204 - protein, 428 aa, GIBBERELLA ZEAE PH-1
MSSRPHNEEPLPLLSAEERDRDMKGELDVEGDAGRAEPPKNNNLEHEYSIPSTVKFAWLGTYFFFSLLLTLYNKLVLGMFHFPWLLTFLHASFASMGTYAMMQMGYFKLSRLGRRENLALVAFSALFTANIAVSNLSLAMVSVPFYQTMRMLCPIFTILIYRVYYGRTYSYMTYLSLLPLIIGAAMTTLGEMSFTDAGFLLTILGVILAALKTVVTNRFMTGSLSLPPIEFLLRMSPLAALQALACATATGEVSGFHQLITSGKVPLPPAFASLFGNGFLALLLNISSFNTNKLAGALTMTVCGNLKQCLTVALGIFLFDVTVDLLNGAGMAVTMLGAAIYSKAELDNKNRKSQQAAAAYKPVDQQSRRSTVLLNEVRKGEDWRTRDVITIMIMGYGVFENMQAQGLHFQIWFSLDEWLRALVDRCPV

SEQ ID NO: 20205 - protein, 526 aa, Oryza sativa (japonica cultivar-group); identical to SEQ ID NO: 5033

SEQ ID NO: 20206 - protein, 241 aa, Prochlorococcus marinus subsp. pastoris str. CCMP1378
MRKSVIAGNWKMHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 20207 - protein, 151 aa, Lactobacillus gasseri
MSNNLDTTLPLFVEAGADILEFHYEATNKPDYWLDYLKDHNVRCGMAINPSTPVNKLKPFLNKLDQVLLMTVKPGFGGQKFEEAAVERLAELQDMIKDENLDLPIEVDGGLDRETLKLTRDAGAKIFVAGSYIFKNGSIEDQVIKLKKEDK

SEQ ID NO: 20208 - protein, 312 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMQHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSK

SEQ ID NO: 20209 - protein, 587 aa, Corynebacterium efficiens YS-314
MMTAQNHLVDTTTRSVPPDMKNRAADSDDLSSFGYEQQLQRNLGRFASFAAGFSFVSILTTIFQLFGLGFGFGGPAFFWTWVAVFIGQYMVALCFAELAARFPVSGAIYQWSRRMGGEFIGWFAGWFMILAQIVTAAAAAIALQVVLPNIWSGFQIIGDDPTLTSPSGAANAVLLGSVLIVLTTVINCIGVRWMSYVTTIGVVCELVGVVAIIGVLFAHAQRGPQVVFETNWTGDSSGYIGAWIASALMAAYVMVGFGSAGELAEETRNPRAVAPKTIRQALSVSALGGGLLILGALMAAPSLTDGRLSVEGLPYVLNTVLESPWGTVLLIDVAIAILICTLAIQTAASRLMFSMARDHRLPASRMLSRVNTTTGTPILPSIVVGVACILILLINVGNDALFATITSVCIILIYLAYLLVTAPLLLRRIQGWPYDRGTSTDANGKQLFTLGRWGLPVNICAVVYGTVMVVNLSWPRAEIYNPSGDTPIMQWAGPIAVGAVIILGLMAFPRNRAHPHPVALESPRNSHTAAAPPATMTITPDPTDVVTGTEATGIHAESARTSTRTSTGTSTGAVVPQSAIPDRSTHF

SEQ ID NO: 20210 - protein, 292 aa, Glycine max
MDQPSRKFLISASEALAMAESAAVTLPELLPTLVPTAQPLARPPISKFSVAAVGLAPSGRILVGVNLEFPGLPLHHSVHAEQFLITNLSLNAEPHLVSLAVSAAPCGHCRQFLQELRAAADVQILVTSEPTAEFGPLSDLLPQRFCPHDLLPLEAPLLLEPHHNTLTLTLHHQHLPNYKLKTAALEAGNNSHAPYSGSPSGVALLDCHSNVFKGSYMESAAFNPSLGPVQAALVAFVSGGGGDYDQIVGAVLVEKEDAVVKQESTARLLINSISPNCQFDTFLCHCNPNHIV

SEQ ID NO: 20211 - protein, 297 aa, Glycine max
MDTAQWAQGIGVVKQPMEGSKPPPPPPPPMLERRARPQKDQALNCPRCNSTNTKFCYYNNYSLSQPRYFCKTCRRYWTEGGSLRNVPVGGGSRKNKRSTPPAPPSAPAPTKKLSDLATPNFPQSASQDPKIHQGQDLNLAYPPAEDYSTVSKFIEVPYSTELDKGTTGLHQNPTSSSTTTSASSQLSAMELLKTGIAAASSRGLNSFMPMYNSTHGFPLQDFKPPHGLNFSLEGFENGYGGLQGIQEGPTGGARILFPTVEDLKQQVPSTNEFDQQNRSQEGSAHGYWNGMLGGGSW

SEQ ID NO: 20212 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVAARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 20213 - protein, 107 aa, Triticum aestivum
MWSFASNAIAGSLKKKGQPSKCSISNPDCSDDEVSSCTSREEGLDCPICWESFNLVENVPYVLWCGHTMCKNCILGLHWAVVKFPSLPIQLPLFISCPWCNLLSFRL

SEQ ID NO: 20214 - protein, 484 aa, Staphylococcus aureus subsp. aureus Mu50
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQN

SEQ ID NO: 20215 - protein, 591 aa, Streptococcus oralis
MTQGKITASAAMLNVLKTWGVDTIYGIPSGTLSSLMDALAEDKDIRFLQVRHEETGALAAVMQAKFGGSIGVAVGSGGPGATHLINGVYDAAMDNTPFLAILGSRPVNELNMDAFQELNQNPMYNGIAVYNKRVAYAEQLPKVIDEACRAAVSKKGPAVVEIPVNFGFQEIDENSYYGSGSYERSFIAPALNEVEIDKAVEILNNAERPVIYAGYGGVKAGEVITELSRKIKAPIITTGKNFEAFEWNYEGLTGSAYRVGWKPANEVVFEADTVLFLGSNFPFAEVYEAFKNTEKFIQVDIDPYKLGKRHALDASILGDAGQPAKAIPDKVNPVESTPWWRANVKTNQNWRDYMNKLEGKTEGELQLYQVYNAIHQHADQDAIYSIDVGDTTQTSTRHLHMTPKNMWRTSPLFATMGIALPGGIAAKKDNPNRQVWNIMGDGAFNMCYPDVITNVQYDLPVINVVFSNGKYAFIKDKYEDTNKHLFGCDFPNADYAKIAEAQGAVGFTVDRIEDIDAVVAEAVKLNKEGKTVVIDARISQHRPLPVEVLELDPKQHSEEAIKAFKEKYEAEELVPFRLFLEEEGLQSRAIK

SEQ ID NO: 20216 - protein, 387 aa, Schizosaccharomyces pombe
MNHGTKIPVDPFRIIKETARDGSTGEVKQLSYTSSKVVGSGSFGVVMQVHLIESDSKAAIKRVLQDKRFKNRELQIMRIMKHPNIVDLIAYYYTTGDNSDEVYLNLVLEFMPETIYRASRLYTRQKLSMPMLEVKLYIYQLLRSLAYIHASGICHRDIKPQNLLLDPENGILKLCDFGSAKILVAGEPNVSYICSRYYRAPELIFGATDYTHAIDIWSTGCVMAELMLGHPLFPGESGIDQLVEIIKILGTPSREQIKTMNPNYMEHRFPQIRPQPLSRVFSRSVPLDALDLLSKMLQYTPTDRLTAAEAMCHPFFDELRDPNTKLHNSRNPDASPRHLPELFNFSPFELSIRPDLNQKLIPSHARDALPVKLDDFVPIPIHRARID

SEQ ID NO: 20217 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 20218 - protein, 267 aa, Oryza sativa
MGRGKVQLKRIENSMNRQVTFSKRRNGLLKKAHEISVLCDAEVAAIVFSPKGKLYEYATDSRMDKILERYERYSYAEKALISAESESEGNWCHEYRKLKAKIETIQKCHKHLMGEDLESLNLKELQQLEQQLESSLKHIRSRKSHLMLESISELQKKERSLQEENKALQKELVERQKNVRGQQQVGQWDQTQVQAQAQAQPQAQTSFFFFFMLRDQQALLSPQNICYPPVMMGQRNDAAARRRWRPKARCNFRIGGFPPWMLSTFKA

SEQ ID NO: 20219 - protein, 796 aa, Escherichia coli
SQPIFNDKQFQEALSRQWQRYGLNSAAEMTPRQWWLAVSEALAEMLRAQPFAKPVANQRHVNYISMEFLIGRLTGNNLLNLGWYQDVQDSLKAYDINLTDLLEEEIDPALGNGGLGRLAACFLDSMATVGQSATGYGLNYQYGLFRQSFVDGKQVEAPDDWHRSNYPWFRHNEALDVQVGIGGKVTKDGRWEPEFTITGQAWDLPVVGYRNGVAQPLRLWQATHAHPFDLTKFNDGDFLRAEQQGINAEKLTKVLYPNDNAFEGKKLRLMQQYFQCACSVADILRRHHLAGRKLHELADYEVIQLNDTHPTIAIPELLRVLIDEHQMSWDDAWAITSKTFAYTNHTLMPEALERWDVKLVKGLLPRHMQIINEINTRFKTLVEKTWPGDEKVWAKLAVVHDKQVHMANLCVVGGFAVNGVAALHSDLVVKDLFPEYHQLWPNKFHNVTNGITPRRWIKQCNPALAALLDKSLQKEWANDLDQLINLEKFADDAKFRQQYREIKQANKVRLAEFVKVRTGIEINPQAIFDIQIKRLHEYKRQHLNLLHILALYKEIRENPQADRVPRVFLFGAKAAPGYYLAKNIIFAINKVADVINNDPLVGDKLKVVFLPDYCVSAAEKLIPAADISEQISTAGKEASGTGNMKLALNGALTVGTLDGANVEIAEKVGEENIFIFGHTVEQVKAILAKGYDPVKWRKKDKVLDAVLKELESGKYSDGDKHAFDQMLHSIGKQGGDPYLVMADFAAYVEAQKQVDVLYRDQEAWTRAAILNTARCGMFSSDRSIRDYQARIWQAKR

SEQ ID NO: 20220 - protein, 690 aa, Cryptococcus neoformans var. grubii
MRKAMANDGQGTTESTEAAMENSQTNLSHTSRTTGPKGTLRVKVISARGLAVSHSPGAEPQPYVVIQFEQNEYVSRPPHPVTSASSVPFTTSTPQPIGTPNNLTRSSSGLGVGAISRAFADAVGRGKKKEDGSGTMTPKAEEPAGGSWLGKPGPGDPVWKEEVSFDVTSSKPTLHLSVYDRNRDGEGFLGMLDIKPVLQDGYVLDNWYKLDTRGDETVTGEVWIQMTYTIIRKRISLKPSDFEFLKLIGRGTFGRVFQVRKKDTRRIYAMKVLSKKEIVAKKEVAHTIGERKILQCSLECPFLVGLKFSFQTDTELYFVTDYKCGGELFWHLQKEGRFQRRSGGLQKEGRFSEDRARFYIAELVLALEHLHKYNIVYRDLKPENILLDATGHVALCDFGLSKPDLTDDKLTNTFCGTTEYLAPEVLLDEKGYGKHVDFWSLGVLLFEMCCGWSPFYAEQTQEMYRLICYGKIRFPKNVIGDDGKQFVKGLLNRNPQNRLGSHRGAVELKEHPFFKNIDWDLLYKKQITPPFKPIVDSDESVANFDPEFTNSSLLDAGIVPWEEVNANVDPGTASQPGKHSYLGPGAGISGSVPGGGGVAINKAQRPGLPGANGSPLTSSVQENFRGFTYTGESLMPQSMLADQSMDSDSDNENAVDDDEDDDEDEEEYEEDDDEENGIGSSRRECDVDMD

SEQ ID NO: 20221 - protein, 149 aa, Oryza sativa (japonica cultivar-group)
MAAAALRDQLTALLSSMFSQGLVDEQFQQLQMLQDEGGTPGFVSEVVTLFCDDADRIINEIATLLEQPVVNFDKVDAYVHQLKGSSASVGAQKVKFTCMQFRQFCQDKSRDGCLMALAVVRNDFYDLRNKFQTMLQLEQQIQAYDPKQQ

SEQ ID NO: 20222 - protein, 353 aa, Cochliobolus heterostrophus
MGCGMSTEEKEGKQRNEEIENQLKRDKLMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAKYYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGPDYAAACDYILNRFVSLNQHETKQIYTHFTCATDTMQIRFVMAAVNDIIIQENLRLCGLI

SEQ ID NO: 20223 - protein, 104 aa, Solanum tuberosum
MAISKALFASLLLSLLLLEQVQSIQTDQVTSNAISEAAYSYKKIGCGGACAARCRLSSRPRLCNRACGTCCARCNCVPPGTSGNTETCPCYASLTTHGNKRKCP

SEQ ID NO: 20224 - protein, 493 aa, Pseudomonas fluorescens PfO-1; identical to SEQ ID NO: 475

SEQ ID NO: 20225 - protein, 365 aa, Xylella fastidiosa Ann-1
MNAQTPTVLDLVRQELRNFAGYSSARSVALTGDFWLNANESAWPNPADSHATMRRYPEPQPPKLRQMLAALYGCLPEQLLIGRGSDEGIDLLVRTVCEPRRDPVLVTPPVFGMYAVSAQLQNAPLIQVPLVDDAAGFHADVPAIITAAQTSRAKLVFLCSPSNPVGAAIPLQQIETILQTLAGTALVVVDEAYGEFSDVPSVVPLLARYPHLVVLRTLSKAHALAAVRIGSVIADAHLVAVLRRCQAPYPLPTPCVSLAEQGLSAAALQITAQRVAEIRAERERLRAALACLSGVRRVYPSQGNFLLVRFDDAEAAFQALYAAGVVVRDQRAAPQLHDALRLTVGTPEQNTRLLAVLRDIQAVPV

SEQ ID NO: 20226 - protein, 134 aa, Staphylococcus aureus
HETDEEINKKAHAIFKHGMTPIICVGETDEERESGKANDVVGEQVKKAVAGLSVDQLKSVVIAYEPIWAIGTGKSSTSEDANEMCAFVRQTIADLSSKEVSEATRIQYGGSVKPNNIKEYMAQTDIDGALVGGA

SEQ ID NO: 20227 - protein, 488 aa, Botrydium stoloniferum
MSKNVQERTRIKSERYESGVIPYAKMGYWDADYNVKSTDVLALFRITPQPGVDPVEAAAAVAGESSTATWTVVWTDLLTACDLYRAKAYRVDPVPGTTDQFFAYIAYQCELFEEGSLANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCMEGINRAAAATGEVKGSYLNVTAGTMEDMYERAEYAKQIGTIIVMIDLVIGYTAIQSMAIWARKNDMILHLHRAGNSTYARQKNHGINFRVICKWMRMSGVDHIHAGTVVGKLEGDPLMVKGFYNTLLNTTLEINLSQGIFFDMDWACLRKTVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPDFVETATESK

SEQ ID NO: 20228 - protein, 429 aa, Bacillus anthracis str. A2012
MLAKRIPIPVAEAVARVMKYAYQGETEEVSLIESYGRTLGEDVIADHDVPHFDRSPYDGFAIRAEDTKEASSSKPIQFEVIGEIGAGVVFTEEVKAFQAVRIMTGAAIPRGCNAVVMLELTEGFEKSEKTYMTLKRCFAAGDNISFKGEDVKQNTILVKEGTVINPGVAALLATFGYSSVHVVKRPIIGIVTTGSELLEVHEQLKPGKIRNSNSYMIAAQIERAGGVVQYYGKFADDFETCFNTVKKAIKEVDILITTGGVSIGDYDYLPAIYERLQANVLFNKIAMRPGSVTTVAEIEGKLLFGLSGNPSACYVGCELYVRPVIGTYLHRKDPHIYRAEAILQKDFSKANPFTRFVRGRVEFADGQLQVTPVGLDKSSAISSLAEANAFIVLPGGTRGFKAGITVSVLLLESTSGSEWPWKESLRSYK

SEQ ID NO: 20229 - protein, 432 aa, Agrobacterium tumefaciens str. C58
MSAAFKNKKRTFVMGRQNRSIPMRKVMEEFHKVRRLPQYVFEQVNRLKASARAAGADIIDLGMGNPDLPTPKAIVDKLCEVVQDPRTHRYSSSKGIPGLRRAQAGYYARRFGVKLNPDTQVVATLGSKEGFANMAQAITAPGDVILCPNPTYPIHAFGFLMAGGVIRSMNVEPDESFFGPLERAVRHSIPKPLALIVNYPSNPTAHVASLDFYKDVIAFAKKHEIIVLSDLAYSEIYFDDNNPPPSVLEVPGAIDVAVEFTSMSKTFSMPGWRMGFAVGNERLIAALTRVKSYLDYGAFTPIQVAATHALNGDGSDIAEVRSVYRRRRDVMVDTFGKAGFEVPPPAATMFAWAKIPEKFRHLGSLEFSKLLVEKADIAVAPGIGFGEMGDDYVRLALVENEHRIRQAARNLKRFLSSADETMHNVVSLNAHR

SEQ ID NO: 20230 - protein, 396 aa, Mesorhizobium loti
MLAHRTNLFGTSGTAAARAAAKAAADAGKEIIDLTAGEIWSELAPTIRDGAIDAINKGVNRYTDSVGMVELREALARKISLDTGQIWKAEEVAVTSGAKQALFNAAMVLLNPGDEVIIPAPYWTTFPAQVLIAGGTPVFVDTKSNGYVPRPEHIKEAVTERTRAIVVNTPSNPAGAVYDVETLMAIAELAVSRNLWIIFDECYGDFVHGGHTHHPIVSVAPEIRARALIVNSFSKSLALTGWRIGYLAGPKGVINAVKALQSHTTSNPNVIAQHAVLAHLQRGGSDYEGKLRSRLTSARRVGLDVLSSLTRVPVARAQGGFYFYLDLSHLLRPGAEDGASTTADDIVTGLLAEAGVAAVSGTAFGDPAGLRLSYGIPPEKLATGLARLVEFLNAWK

SEQ ID NO: 20231 - protein, 508 aa, Oryza sativa
MAGNQQLRVLHALDIARTQLYHFIAIVIAGMGFFTDAYDLFSISLVADLLGHVYYHGELPRNIHAAVTGIALCGTVPGQLVFGWLGDKMGRKRVYGITLLLMVVSSLASGLSFSKHEGMNIIAVLCFFRFWLGVSIGGDYPLSATIMSEYANKRTRGAFIAAVFAMQGFGNLAAGIIGMIVSAAFKHSSASKIDYAWRIILMFGAIPAALTYHWRMKMPETARYTALISKNAKKAAKDMSAVLNVNITPDDEVINELARQDEYGLFSFEFLHRHGLHLLGTTVCWFVLDVTFYSLNIFMKNIFTEVGLLPRLDSEYHHTLQRMITMTAVHTFISLCGALPGYFFTVAFVDRIGRVKIQLIGFTMMTVFMLCLAIPYDQWLRHKNKYGFAVMYGLTFFFANFGPNTTTFIIPAEIFPARLRSTCHGISGAVGKIGAIVGVFGFLYTEYHIRIFLFVLIGCNLVGFIFTLLLPESKGKSLEDLTGEIEEFQEEDEGSEVALSRPIHTVPL

SEQ ID NO: 20232 - protein, 110 aa, Zea mays; identical to SEQ ID NO: 14516

SEQ ID NO: 20233 - protein, 185 aa, Oryza sativa
MADGPGSPGGGGGSHESGSPRGGGGGGGGGGGGGPRVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 20234 - protein, 298 aa, Zea mays
MSFHYHDHGLSMDAAAAAAAAASSPNPSGFSPGIGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGGTMSDDEDNQVDSEANMFDGNDGSDGMGFGPLILTEGERSLVERVRKELKNELKQGYKEKLVDIREEIMRKRRAGKLPGDTASVLKAWWQAHSKWPYPTEDDKARLVQETGLQLKQINNWFINQRKRNWHSNPTSSAEKTKKKR

SEQ ID NO: 20235 - protein, 140 aa, Zea mays
PIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 20236 - protein, 500 aa, Medicago sativa
FLHLRPTPSAKSKALRHLPNPPSPKPRLPFIGHLHLLKDKLLHYALIDLSKKHGPLFSLSFGSMPTVVASTPELFKLFLQTHEATSFNTRFQTSATRRLTYDNSVAMVPFGPYWRFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRRGIVRRRENGEVVEGEASGVFLDTLLEFAEDETMEIKITKEQIKGLVVDLFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 20237 - protein, 456 aa, Oryza sativa
MMEEAYRRQRRAMATHAALAASRIPATARLHSKAASKQRVDFADFSGLRPGSCSISHAAREASFSDVLGSQLVARATGENAVRAPAEAKLKVAINGFGRIGRNFLRCWHERENSPLEVVVVNDSGGVRNASHLLKYDSMLGTFKADVKIVDDQTISVDGKLIKVVSNRDPLKLPWAELGIDIVIEGTGVFVDGPGAGKHIQAGAKKVIITAPAKGADIPTYVLGVNEGDYSHEVANIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLSGILDVCDVPLVSVDFRCSDVSSTIDASLTMVMGDDMVKVVAWYDNEWGYSQRVVDLAHLVASKWPGAAVQGSGDPLEDFCKDNPETDECKVYEN

SEQ ID NO: 20238 - protein, 470 aa, Solanum tuberosum
CRSHRVRAAGEDIEDAAPLKVQGQSSGSVLPYVGVACLGAILFGYHLGVVNGALEYLAKDLGIAENTVIQGWIVSTVLAGAFVGSFTGGVLADKFGRTKTFILDAIPLSVGAFLCTTAQSVQAMIIGRLLTGIGIGISSAIVPLYISEISPTEIRGTLGTVNQLFICIGILVALVVGLPLSGNPSWWRTMFGLALIPSVLLAIGMAFSPESPRWLYQQGRISEAETSIKRLYGKEKVAEVMGDLEASARGSSEPDAGWLDLFSSRYRKVVSIGAAMFLLQQLAGINAVVYYSTAVFRSAGITSDVAASALVGAANVFGTTVASSLMDKQGRKSLLLISYTGMAASMMLLSLSFTWKVLTPYSGTLAVLGTVLYVLSFSLGAGPVPALLLPEIFASRIRAKAVALSLGVHWIMNFFIGLYFLSIVTKFGISTVYMGFALSCLVAVVYITGNVVETKGRSLEEIERELSPAI

SEQ ID NO: 20239 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 20240 - protein, 368 aa, Clarkia breweri
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLTATDKVLLEPWFYLKDAILEGGIPFNKAYGMNEFDYHGTDHRFNKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

SEQ ID NO: 20241 - protein, 318 aa, Prunus persica
METFPVVDLSQITGEKREAAMEKMNDACENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQLEVITNGKYKSVMHRVIAQPDGTRMSIASFYNPGDDAFICPAPALLEKETENISAYPKFVFDDYMKLYSGLKFHAKEPRFEAMKAMESTVNLDPVATV

SEQ ID NO: 20242 - protein, 396 aa, Fusobacterium nucleatum subsp. nucleatum ATCC 25586
MRISDRVKNMKYSAVRKLAPLAAEAEKKGIKVYRLNIGQPNIETPKLFFEGLKNIPDHVIRYADSRGISILLEQVIEVYARDGHILKKEDIIVTEGGSEALTFAMLAICNPNDEVLIPEPFYSNYKSFLDIAGAKIIPIPTDIKNDFALPKKEEIQKLITSKTKAILYSNPCNPTGKVYTEEEVKLLANLAAENDLFVIADEPYREFIYDDNDKHYSLLDIEKAKENVIIIDSVSKHYSACGARVGFLISKNKDFMTYIMKLCQARLAAPTVEQYAVASLMKAPKEYFKEIKEIYKRRRDIIVNSLNKIEGVTCSTPKGAIYAFAKLPVESSEDFCKWLLTEFVYDNSTVMLAPGEGFYETEGLGKNEVRFSFCVGENDIEKAMRVLEEALKVYKK

SEQ ID NO: 20243 - protein, 246 aa, Microbulbifer degradans 2-40
MRRRLIVGNWKMCGDFRTNQKRLEDLSSLWFGVHQTEVSVSPAYPYLAQAAGMLENTNISLCAQDVSTRENGAFTGEVSAAMLADMGCRYVMVGHSERRHYHNEGYDLIAEKFQAVCEAKMIPILCLGETTADREADRTFDVIGRQLLKVVNACGLEGLAKGVVAYEPIWAIGTGRAATPEQAQDVHSYIREILGPEGEQIRILYGGSVKPDTAEGLFAKKDIDGALVGGASLDARDFVAICRAAE

SEQ ID NO: 20244 - protein, 123 aa, Zea mays; identical to SEQ ID NO: 10138

SEQ ID NO: 20245 - protein, 108 aa, Oryza sativa
GTRGNYDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 20246 - protein, 200 aa, Pseudomonas aeruginosa
MRITLLDNFDSFTYNLVEQFCLLGAEVRVMRNDTPLPTIQAALLADGCELLVLSPGPGRPEDAGCMLELLAWARGRLPVLGVCLGHQALALAAGGAVGEARKPLHGKSTSLRFDQRHPLFDGIADLRVARYHSLVVSRLPEGFDCLAESDGEIMAMADPRNRQLGLQFHPESILTTHGQRLLENALLWCGALAVRERLRA

SEQ ID NO: 20247 - protein, 497 aa, Oryza sativa
MDAAGSLQGEREFHNEIAVASHLLASSSAPGSPPVPDAAAKPGGKGRDSILLPFAYSMSSAARGEGRPRRMMLVYDLMPNGSLQDALLGRRCPELVAEWPRRLAVARDVAAALHYLHSVVKPPVVHGDVKPSNVLLDTDLRARLADFGLSRINSDADADGKPESGAIAEGCDVDGGCDDDASVIAESTVTTTVNGEGNPKSPEDDDGFTSASPAEAASTSGFDRTSVESGMNSRSCNGGGSRTGGTMGSGTGSDWWWKQDNGGGSNGVKDYVMEWIRSEIKKERPKNDWIAGAAITNPAADRKKPKRRAREWWREEYADELAKKQKRRALAKSKSEQAGLQWWERDIDDDLDAKGRSKWSMMKSWSRRSNGSTGNGNGNGNGSINWWVNGARSTRDWASGEFVPKSSGAVSSTPSMRGTVCYVAPEYGGGGPLSERCDIYSYGVLLLSHSFASKGLQLVDHQVRRIAIADLKYEGQPGHYVFWKGFIEVILTWFDTV

SEQ ID NO: 20248 - protein, 298 aa, Oryza sativa
MALEAVVFPQGHFGYGCGRDSPAYGMPWCDVLAAAGGGGGFGEFYGVDEWDDQLQVASVDEWEVASKDNSDASTEGKAAAAERAEPVAAGRRKRRRTKVVKNNEEIECQRMTHIAVERNRRRQMNEYLAVLRSLMPASYSQRGDQASIVGGAINYVKELEQLLQSLEVQKSLKNRSGAMDAAGDSPFAGFFSFPQYSTSPRTGCSSAAIADIEVTMVEGHASLKVLARRRPKQLLKLVVGLQQLRIPPLHLNVTTVDAMVLYSFSLKVEDDSKLGSVEDIATAVHQILGSIQQQEAVL

SEQ ID NO: 20249 - protein, 556 aa, Yersinia pestis KIM
MWSLKESMEIFFTILILILVVSLSGVVTRMLPFQVPLPLMQIVCGALLAWPNFGLHVNFDPELFLVLFIPPLLFADGWKTPTREFIHHGREILGLALALVLVTIVGIGYLIYWMVPGIPLVAAFALAAVLSPTDAVALSGIVGKGRIPKSIMGVLEGEALMNDASGLVALKFAIAVAMGTMIFTVSGATLEFLKVAIGGLLAGVAITWLYSKSLRIMSRWSGDDPATQIVLLLLLPFASYLVAEHLGVSGILAAVAAGMTISQSGIIRNAPLAMRLRADSVWSMLEFVFNGMVFILLGLQLPGILETSITQAELDPTIQTWNLFADVAIIYGALLLLRFGWLWSMKKISKRVLTKRPLQFSDYTTRELWVASFAGVRGAITLAGVLSIPLFLSDGSAFPSRYQLVFIATGVILLSVIIGVIALPPLLRGVVVADKSASREEIRLARAAMAEVAIVSLNKMEERLMTSSEENIDSELLKEVSSRVIGTLRRRTGSKDEVENTLLIENLERRFRLTALRAERGELYHLRATQKISNETLQKLLHDLDLLEALLIEKEG

SEQ ID NO: 20250 - protein, 447 aa, Xanthomonas campestris pv. campestris str. ATCC 33913
MWAIAAVLVAAIAAFPIITLITINVLVALGFLATFGLKLLLVWFGSRHRIDIKVTEDEVAALRDDDLPVYTVLVPMYKEPEVLPILANALRKLDYPISKLDVKLVLEADDFDTIEAAKKLGLEAFFEIIRVPPSQPKTKPKACNYALHFARGELLTIYDAEDKPEPDQLKRVVAAFRKAEKDVVCIQARLNYYNADENWLTRMFTLEYTLWFDFYLPALEYLRIPIPLGGTSNHFRLDVLRQVRAWDPYNVTEDADLGVRLIQNGYRVNVVNSTTFEEANVSIPNWIRQRSRWLKGYMQTWLVHMRDPVHLYRSTGFKGFWGFQFFIGGNFFIALGVPVMWTLCLISMLSGARIFDATFPPWLATISLVNLLLANAFFIYVTLVAAFKRDYFKLAPYALTVPFYWLLQSIAAYKGLWQLIRNPFYWEKTTHGISKHSEQERRAALEE

SEQ ID NO: 20251 - protein, 480 aa, Gracilariopsis costaricensis
ARIKNERYESGVIPYAKMGYWDPDYVIKDTDVLALFRVTPQPGVDPVEASAAVAGESSTATWTVVWTDLLTACDLYRAKAYKVEAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRAVAATGEVKGHYMNVTAATMEDMYERAEFAKQLGSIIIMIDLVIGYTAIQTMAIWARKNDMILHLHRAGNSTYSRQKIHGMNFRVICKWMRMAGVDHIHAGTVVGKLEGDPLMIRGFYNTLLQTNLEINLPQGIFFEQDWASLRKVTPVASGGIHCGQMHQLLDYLGNDVVLQFGGGTIGHPDGIQAGATANRVALEAMVMARNEQRDYVAEGPEILRDAAKTCGPLQTALDLWKDITFNYTSTDTADFVETPTANV

SEQ ID NO: 20252 - protein, 190 aa, Dechloromonas sp. RCB
MLLMIDNYDSFTYNLVQYFGELGQDVKVFRNDAISLSEIAQMKPDYLVISPGPCAPAQAGVSLAAIKEFAGKIPLLGVCLGHQSIGEAFGGKIVHAKQLMHGKVSPVHHKDIGVFRGLPNPLTCTRYHSLAIERATLPDCLEITAWTDDGEIMGVRHKTLAVEGVQFHPESILTECGHDLLKNFLEEHKQ

SEQ ID NO: 20253 - protein, 535 aa, Eremothecium gossypii
MTVSEGMTPSKSELSGDGSNSHPIESKKDIVSVISTETKPFSAYIFACLCCFMVAFGGFIFGWDTGTISGFVKQTDFIARFGQLSPSGEYELSDDRTGLIVSIFNIGCAVGGIFLSKIGDAYGRKIGLATVTAVYVIGIVIQISASDKWYQYFVGRIISGLGVGGIAVLSPMLISETSPKHLRGSLVSCYQLMITAGIFLGYCTNYGTKTNYTDSRQWRIPLGLGFAWALLMIGGMAFVPESPRYLVEAENLPKARMSIARANKVAEDHPIVEHELNTLQTAIELEKLAGKARIVDLFNVKKKIFQRLIIGIFIQSLQQLIGNNYFFYYGTTIFNAVGMDDPFVTSIVLGIVNFGSTFFSLYTVDKFGRRKCLIWGAFAMAICMAIFASVGVTKLWPNGEDQPSSKPAGNVMIVFTCIYIFFFATTWAPIAYVIISEIYPLRVKARAMALATAANWIWGFLIAFFTPRITSAIKFCYGYVFMGCLIFAFFYIFFFVPETKGLTLEDVDEMWQEGVVPWGSESWLPRSDREVAHDA

SEQ ID NO: 20254 - protein, 318 aa, Zea mays
MGGEAKKLPRIDFSEVDPSAPGGQAWGTARGEVMDALATFGCFEAHCPALTPRLRAELFDGAVRPLFALPADAKRRNCYGADRPFHGYLGDVPGFPGYESLAIVDGTKDESVRGFARLMWPDGGDNSDSFCGTVVEAAQRIFQLEEAVRRMVMEGLGVAKHHDALSASMWHLFRMAEYKAPNAAEKVVRYGAHQDTNWLSVVCQHEVAGLEVQSRDGEWIVVQPSPTSLVFMVGNELRAWTNDRLYAPFHRITVAGDVPRYSAMLFSVPSFQVQVADELVDDEHPPRFKPHDNNDFVCFCVSEEGALHQDKLKAFCGV

SEQ ID NO: 20255 - protein, 285 aa, Pyrococcus furiosus DSM 3638
MIAGILLALGAAFSWALSSVLSKMIMERISPLSLNIVRLLISGLVYLGMFLVLPFPNKPILWWLIVIASGVLGFTVADFMFLKGMKEVGVSRASILVTPHPILTMILAHYFLGRPLNSGIFLGAFLIVLAVIILLSESGNRESKTSFEGVLWIFGAEALWTVAVLLTDWLVENESPLLITGLRIIGGSIGAIFFVPSVLKEVKRISIRDYVWIVIITFLGTVIGQYLFVMAIRLVTSSIATPITESSPIMATILAAFILKEEITERIFISIILAFVGVILIGIFM

SEQ ID NO: 20256 - protein, 334 aa, Triticum aestivum
TRASRRNPAQSQRGLLLPPPLRIRVFWRPSSLPFLQFSLHNATAAASHLPSPRTESQTLSRRPGAHQPPYLAPPGGRSPPTVADHQAHACGGAAGRRLTRGPVRRRHADAGGAQGAPQRLRLGHRELPIVSNGGVVLRQPSKPAKPAAAAEGEEQHGGLSRCASTSPTPVGEEVSGGGGITQLSGSYASDIYTYLRTMEVEAPRRPAADYIEAVQTDVTANMRAILIDWLVEVAEEYKLVADTLYLTVSYVDRFLSANPLGRNRLRLLGAAACPIASKGGESCPPRVGVACGCSHDARARLGPLTMESDILKLLNFEIGSPTIKTFLRRFTRSG

SEQ ID NO: 20257 - protein, 374 aa, Glycine max
  unsure (1)..(374): unsure at all Xaa locations
MGEDSTRPAEFGESTKINHKMENVEREEEIDPESNPLNEPLLKRNRTLSSNPLALVGEKVSYIESLDYEINENDLFKHDWRSRSRVQVLQYIFLKWLLAFLVGLLTGIIATLINLAVENIAGYKLLAVLKYIHKERYLTGFLYFTGINFVLTFVAAILCVCFAPTAAGPGIPEIKAYLNGVDTPNMFGATTLIVKIIGSIGAVSAGLDLGKEGPLVHIGSCIASLLGQGGPDNYRTKWHWLRYFNNDRDRRDLITCGSSSGVCAAFRAPVGGVLFALEEVATWWRSALLWRTFFXSTAVVVVVLRAFIEICHTGKCGLFGEGGLIMFDVSNVTVRYHVMDIVLVVVIGIIGGVLGSLYNHVLHKVLRLYNLINQ

SEQ ID NO: 20258 - protein, 548 aa, Glycine max
  unsure (1)..(548): unsure at all Xaa locations
MAASAGGQITLSSTVQLHGVACSRNWKLVKFCNGEVMGRKLVLKSAYGGSTKDVRHHQQQQHICMSLTADVSTESKLRDLDMERRNPRTVLAVILGGGAGTRLFPLTKRRAKPAVPIGGAYRLIDVPMSNCINSGINKVYILTQFNSASLNRHIARAYNSGNGVTFGDGYVEVLAATQTPGEAGKKWFQGTADAVRQFHWLFEDPRSKDIEDVLILSGDHLYRMDYMDFVQNHRESGADITLSCLPMDDSRASDFGLMRIDNKGRILSFSEKXPKGEELKAMQVDTTVLGLSKDEAQKKPYIASMGVYVFKKEILLNLLRNMHREXLILFQSLFFKCYKLIXFRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNVHLKDTVMLGADYYETDAEVVALLAEGRVPIGIGENTKIKDCIIDKNARIGKNVVIANSEGIQEADRSSEGFYIRSGVTIVLKNSVIEDGFII

SEQ ID NO: 20259 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 20260 - protein, 620 aa, Streptomyces viridifaciens
MTEQATGAHHPQPRPRSGGQQSAPVEYVTGAQSLIRSLEEVGADTVFGIPGGAILPAYDPLMDSTRVRHVLVRHEQGAGHAATGYAQATGKVGVCMATSGPGATNLVTPIADAHMDSVPLVAITGQVASKSIGTDAFQEADIVGITMPITKHNWLVTKAEDIPRVIAQAFHVASTGRPGPVLVDIAKDALQARTTFSWPPVMDLPGYRPVTKPHAKQIREAAKLITTARRPVLYVGGGVLKAQATAELKVLAELTGAPVTTTLMALGAFPDSHPLHVGMPGMHGSVAAVTALQKADLIVALGARFDDRVTGRLDSFAPYAKIVHADIDPAEIGKNRAADVPIVGDAREVIADLVQAVQKEHSEGHKGDYTAWWSDLNRWRETYPLGYDLPEDGSLSPQQVIERIGRLAPQGTIFAAGVGQHQMWSAHFIQYDRPATWLNSGGAGTMGYAVPAAMGAKAGRPEQTVWAIDGDGCFQMTNQELTTCALNNIPIKVAVINNGALGMVRQWQTLFYNQRYSNTQLRGEPSARAHGTRVPDFVKLSEAMGCVAMRCEDAADLDTVIAKANSINDQPVVVDFIVHEDAMVWPMVAAGASNDEIMAARDVRPLFDDAAEDFTAETPM

SEQ ID NO: 20261 - protein, 698 aa, Oryza sativa (indica cultivar-group)
MAPPGVGVGVAYLWGKGRGGRKGTPVVVTMESPNYSVVEVDGPDAEAELRTAAVAMDKGGGRGRSRSRTARQLTWVLLLRARRAAGRLASFAAAAARRFRRSPADAADELGRGRGRLMYGFIRGFLALSLLALAVELAAYWNGWRLRRPELHVPEAVEIEGWAHSAYISWMSFRADYIRRPIEFLSKACILLFVIQSMDRLVLCLGCFWIKLRKIKPRIEGDPFREGSGYQHPMVLVQIPMCNEKEVYEQSISAACQLDWPREKFLIQVLDDSSDESIQLLIKAEVSKWSHQGVNIVYRHRVLRTGYKAGNLKSAMSCDYVKDYEFVAIFDADFQPTPDFLKKTIPHFEGNPELGLVQARWSFVNKDENLLTRLQNINLCFHFEVEQQVNGVFLNFFGFNGTAGVWRIQALEESGGWLERTTVEDMDIAVRAHLNGWKFIFLNDVKVLCELPESYEAYRKQQHRWHSGPMHLFWLCLPDILTAKISSWKKANLILLFFLLRKLILPFYSFTLFCVILPLTMFVPEAELPVWVICYVPVCMSFLNILPSPRSFPFIVPYLLFENTMSVTKFNAMVSGLFKLGSSYEWIVTKKSGRSSESDLSTAVERDTKDLTLPRLQKQISESELIDLKMQKERQEKAPLGAKKANKIYKKELALSLLLLTAATRSLLSAQGIHFYFLLFQGVSFLFVGLDLIGEQID

SEQ ID NO: 20262 - protein, 325 aa, Arabidopsis thaliana
MMGSILLLLLFFSLVQSRSDTSYSKIQLPGDSLTLSVTDFGATGDGINYDTSAIQSTIDACNRHYTSFSSICRVVFPSGNYLTAKLHLRSGVILDVTENAVLLGGPRIEDYYPAETSSDWYVVVANNATDVGITGGGAIDGQGSKFVVRFDEKKNVMVSWNQTGACLGDECRPRLVGFVDSINVEIWNITLREPAYWCLHIVRCENTSVHDVSILGDFNTPNNDGIDIEDSNNTVITRCHIDTGDDAICPKTYTGPLYNLTATDCWIRTKSSAIKLGSASWFDFKGLVFDNITIFESHRGLGMQIRDGGKQVSSFLWLHTTQKLM

SEQ ID NO: 20263 - protein, 338 aa, Archaeoglobus fulgidus DSM 4304
MELAVIVFAAAIAAIISRMLRITPIPAYILVGMALGKAGWHLSEVEFLGKLGIVFLLFYVGLKIPPSTIKKTWQRTLKSGTIDFLFNFLPPLVLLYLIGFDLRDAFILASAIYISSSAINLKMLVDDRKLVFTFAEVVVLLMVFEDIVLVALLFLFSASEPLTLLYLALIALTALALYAISPQIEKLMSREDEVPYLLTFSIPSISLFLAEKFRISEALMAILFGVALNRLRIDKMLVPFKEVFLAVFFVFFGTMVDLHFSYLSLLLIAVAVIGKLAGAYFIARFTTSKSDAVEVFKYTLARGEFTVIFPALFAPEFATTLAAVVLFTSIAGSLIAKL

SEQ ID NO: 20264 - protein, 113 aa, Triticum aestivum
  unsure (1)..(113): unsure at all Xaa locations
MAPTVMASSATSVAPFQGLKXXVGLPVSRRSNGASLGSVSNGGRIRCMQVWPXEGIMKFETLSYXPPXRXETLLKQXXYLIXRSKXVPXLXFXSXXXFILRXLXEXXXYXESS

SEQ ID NO: 20265 - protein, 143 aa, Glycine max
MNSTEEGMQGIGIGIGCFQNDVVGQLELSPTMSNSSSSLSMELDESPESRIQRLISEHPVIIFTRSSCCMCHVMKKLLATIGVHPTVIELDDQEIAALPDTSAPSAFIGGTCIGGLESLVGLHVTGHLIPKLVQVGALWLGRI

SEQ ID NO: 20266 - protein, 387 aa, Arabidopsis thaliana
MASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 20267 - protein, 428 aa, Lycopersicon esculentum
MNGDMNQQQQQQQLQQQQQQQWMAMQQYQQQWMAMQQYPPAAAMVMQQQMMYGQQYMPYYHQQHQQMIQIQQNASEDNRTIWIGDLQQWMDEGYLHTCFAQAGEVISVKVIRNKQTGQSERYGFIEFNTHEAAEKVLQSYNGTMMPNAEQPFRLNWSAFSSGEKRADVGAGAGSGSDLSIFVGDLASDVTDTMLRDTFSSRYPSVKGAKVVIDSNTGRSKGYGFVRFDDESERSRAMTEMNGIYCSSRAMRIGVATPKKPSPMQQYFPQAVILAGGHASNGAATQTSQTDSDLSNTTVFVGGLDSEVTDEELRQSFSQFGNVVSVKIPAGKGCGFVQFSERSAAEDAIEKLNGTVIGAQTVRLSWGRNPANKQFRTDSGSQWNGGYYGRQNYGGYGYGASQSQDSMYGAGAAHGASSNGYGNHEQSVS

SEQ ID NO: 20268 - protein, 662 aa, Oryza sativa
  unsure (1)..(662): unsure at all Xaa locations
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILVRPTQGQDIRNVGCDIQKDSVVLKSSEHIGPAEIGVLATVGVTTVKVYRRPTIAVFSTGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKXSVIEKEAPGLTYVMLQESLKVTPFAMLSRATAGIRGSTLIINMPGNPNAVAECMEALLPALKHALKQIKGDKREKHPRHVPHAEAAPVDQWDRSFRAASSGRGCSCEP

SEQ ID NO: 20269 - protein, 409 aa, Zea mays
GLSFGHTPKGVIATLCFFRFWLGFGIGGDYPLSATIMSEYANKKTRGAFIAAVFAMQGFGILFGTIVAIVVSAAFRNAFPAPPYFVDAQASLVPEADYVWRVILMFGTVPAALTYYWRMKMPETARYTALIARNTKQATADMAKVLKKEIEAEEEQVERQVVGADTWGLFSAQFLRRHGLHLLATSSTWFLLDIAFYSQNLFQKDIFTKVGWIPPARTMNAIEEVYRISRAQALIALCGTIPGYWFTVGLIDIVGRFWIQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDHGYSPGIGIRNTLFVLAGTNFLGMLMSVFVPESKGMSLEEISKENVDDEADAEV

SEQ ID NO: 20270 - protein, 517 aa, Sorghum bicolor
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 20271 - protein, 130 aa, Glycine max
MADPELEAIRQRRMQELMAQHGTQGKQGSQQNPDQERAQEDAKREADERRQMMLSQILSSQARERIARIALVKPEKARGVEDVILRAAQMGQIVEKVSEERLITLLEQINSQTSKQTKVTIQRRRGVFDD

SEQ ID NO: 20272 - protein, 142 aa, Glycine max
  unsure (1)..(142): unsure at all Xaa locations
GYGSQHTNYDITSIASNGGRVQCMQVWPPGGXKKVETVSSLPDLDDAQLAXEVKYLLRKGWIPCLEFELKHGFVYREHNRSPGYYDGRYWTMCEAAMFGCTDASQVSQELQEPRLHTLRLDAFMRFRHVRRALCMSLIAYMP

SEQ ID NO: 20273 - protein, 507 aa, Candida tropicalis
MIEQVLHYWYYVLPAFIIFHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 20274 - protein, 484 aa, Grateloupia filiformis
SVERTRIKNERYESGVIPYAKMGYWDPDYVVKDTDVLALFRVTPQPGVDPVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILQDAAKTCGPLQTALDLWKDITFNYTSTDTADFVETPTANV

SEQ ID NO: 20275 - protein, 506 aa, Xanthobacter autotrophicus
MNSPAFLSSAHTSPFKPRYGNFIGGTFVEPVSGRYFENTSPITGKVICEVPRSDEHDIERALDAAHAAKKAWGRTSAADRALVLLKIADRLEANLELLAGAETWDNGKPIRETTLADIPLAIDHFRYFAACVRAQEGTLGEIDHDTIAYHYHVPLGVVGQIIPWNFPILMAAWKLAPALGAGNCVVLKPAEQTPASILVLAELIADLLPPGVLNIVNGFGLEAGKPLASSPRISKIAFTGETGTGRLIMGYAAQNLIPVTLELGGKSPNIFFADVAAEDDDFLDKAVEGFVMFALNQGEVCTCPSRALVQESIFDKFMEKALARVAAIKQGSPLDPSTMIGAQASSEQMHKILSYIDIGRAEGAQVLAGGERNVLTGELADGFYVKPTVFLGKNNMRIFQEEIFGPVVSVTTFKDEEEALHIANDTLFGLGAGLWTRDGSRAYRVGREIEAGRVWTNCYHAYPAHAAFGGYKQSGIGRETHKMMLDHYQQTKNLLVSYSPKKLGFF

SEQ ID NO: 20276 - protein, 302 aa, Antirrhinum majus
MVSSHRSLMEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 20277 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITNDKAIPLTKQLMNDYEKTHASTIAVMPVPHEDVSSYGVIAPQGEGINGLYSVETFVEKPAPEEAPSDLAIIGRYLLTPEIFEILENQAPGAGNEIQLTDAIDTLNKTQR

SEQ ID NO: 20278 - protein, 465 aa, Streptomyces coelicolor A3(2)
MTSPGTRADADAEDLDVEEALALVRETPGHGSHDNGSHGSHGRRDSHGGHGAPAPHHPADAHHQTTPWPEARATAERAARTAARAARRTPVAVPLDAALGLTLAAPLAALTDLPSFDTSAMDGWAVAGPGPWAVRDEGVLAGHAAPAPLIDGEAVRIATGARIPPDTTAVLRTEHGRSDERGRLHPTREVVHGQDIRPRGQECRSGDQLLPVGTLATPAVLGLAAAAGYDTLTAVPRPRVDVLVLGDELLTQGLPHDGLIRDALGPMLPPWLRALGAEVRTVRRIGDDAKALHRAVTTSEADLIVTTGGTAAGPVDHVHPTLRRIGAELLVDGVKARPGHPMLLARLKDDQHLVGLPGNPLAAVSGLLTLAEPLLRTLAARPAPEPYTLPLRDAVHGHPHDTRLVPVVLRGEGAVPLRYNGPAMLRGIAAADALAVVPPGGARSGQEAELLDLPWATGGIGVCFT

SEQ ID NO: 20279 - protein, 250 aa, Zea mays
MSVLLRSRALISTPPMAPPPTSPSFLRPPPLPHHPHPRLLLRPPSASFRVAEILGGRGLCNGEVGVRKELASGSTTSSPAPSPPPSTDSPPPAVDPDAFEKEMMGLTGGFPGGEVGLKDFVAKNPPPPKKSESQPQATLSAPPRPPELPLFLPGMVVLVKNPNNAYHMYCGIVQRVSDGKVAVLFEGGVWDRLITFNLDELEGREKGPPMANPKSVVLEDLVAELEDDDDDKEDEAAKKKEPEGAAAAAT

SEQ ID NO: 20280 - protein, 438 aa, Azospirillum brasilense
MSRLFTLAAPTMAAILGLAGLPAAALAQESAAAAAEPTLSSGDTAWMLVATALVLFMTIPGLALFYGGMVRKMNVLSVVMQSFAICCLVSILWFFAGYSIAFTEGTPYFGSLSKFMLAGITKDSLTGVIPETIFVVFQMTFAIITPALITGAFADRMKFSSMLVFTGLWSLIVYAPITHWVWGPGGYLAGDGVLDYAGGTVVHINAGVAGLVAAIVLGKRKGYPNENFAPHNLVLSLIGASMLWVGWFGFNAGSAVAADGRAGMAMLVTQIAAATAAMSWLLVEWATKGKGSVLGIISGAIAGLVAITPASGFVGPTGALVIGLAAGVICYWGATGLKRALGYDDSLDAFGVHGVGGIVGAILTGVFAQEAIGGTAGALEGNVGQIWTQVYGILATIVYSAVGSFIILKVIDVVMGLRVDEDVERDGLDLALHGETIH

SEQ ID NO: 20281 - protein, 359 aa, Triticum aestivum
  unsure (1)..(359): unsure at all Xaa locations
LFFADRFCSFALSAWFGAHTGKIKIGINGFGRIGRLVARVALQSDDVELVAVNDPFITTEYMTYMFKYDTVHGHWKHSDIKLKDDKTLLFGEKPVTVFGVRNPEEIPLGEAGADYVVESTRVFTXKDKAAXHIKGGAKKVIISAPSKDAPMFFFWVNXKEYKSXIDIVSNXSGTTNCLAPLXKVINDRVGIVEGLMTTVHAMTSTQKTVEGPSSKDWRGGRAAXXNIIPSSTCAAKAVGKVLPELNGKXLTGMAFRXVPTVDVSVVDLTVRLAKPATYDQIKAAIKEESEGNLKGILGYVDEDLVSTDFQGDNRSSIFDAKAGIALNDNFVKLVSWYDNEWGYSTRXWVDLIRHMHSTK

SEQ ID NO: 20282 - protein, 170 aa, Zea mays; identical to SEQ ID NO: 2818

SEQ ID NO: 20283 - protein, 656 aa, Schizosaccharomyces pombe
MSNSQSIKIKKPRSNENFASGSYSSRRSQQIHRLSHSPMAEGFHKPKLNISPSESNLPNNVAENTTDTPVNYGSIRDENHNSRKGKDVTLNSDEAHSENVPSTSEDPDVVRRHLGGQAADDDNFSSLQLQGGDMHRQVYRWQQEVDQNKQIRRGRSRSFSAKVSDPNLHLRSVQDMKQAGGMRRDFLRNRASSISMSSNAHGNPNFLNRNFIEFLSVYGHFAGEELSEEDEDEDTDDFAMPRDVNPSLIHSTVPSEQEPLISRHGRYKLQTPGNASNGKAVLLLLKSFVGTGVLFLPKAFKLGGLVFSSATLLIVGVLSHICFLLLIQTRMKVPGSFGDIGGTLYGPHMRFAILASIVVSQIGFSSAYISFVASTLQACVKVISTTHREYHLAVFIFIQFLVFVPLSLVRKISKLSATALIADVFILLGILYLYFWDVITLATKGIADVAMFNKTDFSLFIGVAIFTYEGICLILPIQEQMAKPKNLPKLLTGVMAAISLLFISIGLLSYAAFGSKVKTVVILNMPESTFTVIIQFLYAIAILLSTPLQLFPAIAIIEQGIFTRSGKRNRKIKWRKNYLRVLIVILAILISWAGSSRLDLFVSMVGSVCCIPLIYMYPPMLHYKACANNWILRTLDIFMFTIGAFAMAFTTYMTFF

SEQ ID NO: 20284 - protein, 227 aa, Burkholderia fungorum
MTQFRIAPSILSADFARLGEEVRNVVAAGADWIHFDVMDNHYVPNLTIGPLVCEAIRPHVDVPIDVHLMVRPVDRIVPDFAKAGANLISFHPEGSDHIDRTLSLIRDHGCKAGLVFNPATSLNYLDHVMDKVDLVLIMSVNPGFGGQSFIPEALNKLREARQRINAYTERTGREIHLEVDGGVKVDNIAEIAAAGADTFVAGSAIFGQPDHKVVIEKMRAALANIQH

SEQ ID NO: 20285 - protein, 335 aa, Xylella fastidiosa Temecula1
MTQTITVIRGDGIGPEIMDATLSVLNALQANLNYEFADAGLSALEKHGDLLPESTLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 20286 - protein, 264 aa, Triticum aestivum
  unsure (1)..(264): unsure at all Xaa locations
RVINCATEKLFKSFLGHGDAXNEIRTQPLKPSLFISASMDESVRLWNVHTGICILIFAGGGGHRNEVLSVDFHPSDIYRIASCGMDNTVKIWSMKEFWPYVEKSFTWTDLPSKFPTKFVQFPLMTSVVHSNYVDCTRWLGDFILSKSVDNEIVLWEPKIKEQGPGEGSIDVLQKYPVPDCDIWFIKFSCDFHFNQLAIGNREGKIYVWEVQASPPVLITRLSSPQCKMPIRQTAVSFDGSTILACGEDGSIYRWDEVEHQAAKN

SEQ ID NO: 20287 - protein, 147 aa, Pectobacterium carotovorum subsp. carotovorum
KPGMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMG

SEQ ID NO: 20288 - protein, 252 aa, Streptococcus thermophilus
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAPEFVGAQVSAALAGLTLKQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 20289 - protein, 175 aa, Zea mays
  unsure (1)..(175): unsure at all Xaa locations
RYPGILKHAPAXLLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 20290 - protein, 332 aa, Oryza sativa
  unsure (1)..(332): unsure at all Xaa locations
GETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRAPPPPPPSKTMISPKPSPPRCKASTXQPSSSPATTRQLQTADDDDDDLVAQLPPQQPTVPKDDQYNVDMSSVAAARCSFPDDVQTYFGLDDDGFGYPEVDTFLFGDLGAYAAPMFQFELDV

SEQ ID NO: 20291 - protein, 516 aa, Bifidobacterium longum DJO10A
MTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 20292 - protein, 299 aa, Methanosarcina mazei Goe1
MDRIISVVGHTALDYIVDVENIAGKNESSPVIDYEEYPGGGAANIAVAIAKLGGKSQLISPVGTDFSSSGYEKLLKEAYVDLSRLYTIEDRKISKAFIFTDREDNQTTYFYWGASSKFKELEPEPVDFVHLATADCVYNAKIAQIAGFVSFDPGQDLVTYSKENLETILAHTDILFANKHEIKRVSEMTGKSFSELRDMIDVIVVTYDAEGSIIYRGGDQWSIPVVSVKALDPTGAGDAYRAGFLLAYTREYSLPTCGKIGSTVASFAVQSRGCQTSLPTWEEMKSRYEASFGNLGAEI

SEQ ID NO: 20293 - protein, 471 aa, Ahnfeltiopsis humilis
  unsure (1)..(471): unsure at all Xaa locations
SGVIPYAKMGYWDPDYVVKDTDVLALFRVSPQPGVDPVEASAAVAGESSTATWTVVWTDLLTACDLYRAKAYKVDAVPNTSDXYFAYIAYDIDLFEEGSIANLTASIIGNVFGFKAVKALRLEDMRLPVAYLKTFQGPATGIVSERERMDKFGRPFLGATVKPKLGLSGKNYGRVVYEGLKGGLDFLKDDENINSQPFMRWKERYLYSMEGVNRSVAASGEVKGHYLNVTAATMEQMYERAEFAKQLGSIIIMIDLVIGYSAIQTMAVWARANDMILHLHRAGNSTYSRQKIHGMNFRVICKWMRMAGVDHIHAGTVVGKLEGDPLMIKGFYDTLLLPYLKVNLPQGIFFEQDWASLRKVTPVASGGIHCGQMHQLLDYLGVDVVLQFGGGTIGHPDGIQAGATANRVALESMVIARNEGRDYVTEGPQILQDAAKTCGPLQTALDLWKDITFNYTSTDTADFVETPTANV

SEQ ID NO: 20294 - protein, 207 aa, Rhizobium galegae
MCAHLPAGHSFEWRKACRRKTTNRVIMTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 20295 - protein, 251 aa, Heliobacillus mobilis
MRKTIIAGNWKMHKTIAEAVTLAEAIKSQNPNPTVEIVICPPFTALAEVAKAVQGSPVAVAAQNMHWEVQGAFTGEVSPAMVKDAGCKYVVLGHSERRQYFGETDETVNKKVKAAIAHELIPIVCVGETLEQREAGQTEDVVATQTKGGLAGLSAQEVADLVIAYEPVWAIGTGRTASDDDAQQVNAYIRSVVAEVFGKEAAEAVRIQYGGSVKPSNAENLLAKGDIDGALVGGASLKIEDFQGIIDGAKA

SEQ ID NO: 20296 - protein, 869 aa, Pseudomonas aeruginosa PAO1
MSSRKIGLNLVVIVALAALFTGIWALYNRPVSVPDWPERISGFSFSPFRLNQNPQSGRYPSAEQMRTDLELVARHTHSIRTYSVQGALGDIPALAEAFGLRVSLGIWLGPDLASNEAEIARAIRIANESPSVVRVIVGNEALFRREVTAEQLIAYLDRVRAAVKVPVTTAEQWHVYREHPELAQHVDLIAAHVLPYWEATPVADAVDFVLERARELKAAFPRKPLLLAEVGWPSNGRMRGSAEATPADQAIYLRRLTNALNGEGYSYFVIEAFDQPWKVSAEGSVGAYWGVYNADRKAKFNFTGPVVPIPKWRALAIASAVLAVLAFTLLLIDSSSLRQRGRTFLAVVSFACASVLVWIAYDYSQQYSTWFSLTVGALLGVGALGVVIVLFTEAHELAEAVWTRKRRRPFLPITAARAYRPKVSIHVPCYNEPPELLKQTLDALARLDYPDYEVLVIDNNTRDPAVWQPVEAHCARLGERFRFFHVAPLEGFKAGALNFALGHVAADVEVVAVIDADYCVDPDWLRHMVPHFGDPRIAVVQSPQDYRDQHESAFKRLCYAEYKGFFHIGMVTRNDRDAIIEHGTMTMIRRSVLDELRWPEWCITEDAELGLRVFEKGLSAAYFERSYGKGVMPDTFIDFKKQRFRWAYGAIQIMKRHTDALLRGRGPDGSRLTRGQRYHFVAGWLPWIADGLNIFFTLGALLWSAAMIIVPKRVDPPLLIFAILPLALFVFKVGKILFLYRRTVGVDLRDSFFAALAGLSLSHTIAKAVLYGFVTRGIPFFRTPKMRSSHGLLVALAEAREEVFVMLLLWGAAAGIVAVQGVPSRDLLIWVAMLLVQSLPYLAALVMALLSSLPKPREELAGGAEQIGG

SEQ ID NO: 20297 - protein, 257 aa, Arabidopsis thaliana
MVENGEEEASSMPHGVTGEESIGSIPFQVLSWRPRAIYFPNFATAEQCQAIIERAKVNLKPSALALRKGETAENTKGTRTSSGTFISASEESTGALDFVERKIARATMIPRSHGESFNILRYELGQKYDSHYDVFNPTEYGPQSSQRIASFLLYLSDVEEGGETMFPFENGSNMGIGYDYKQCIGLKVKPRKGDGLLFYSVFPNGTIDQVNKFMLIGALCCGSNASADFASRELPGDQRREMGGNQMDQRPRPGRIS

SEQ ID NO: 20298 - protein, 1465 aa, Adiantum capillus-veneris
MATPGGPKTKHSVSVAQTRADARLHAAFEGSGDAGAGGSRAPFDYSKSGMDASSVTSVAPEAITAYLQRMQRGGLTQAFGCMLVVAGQKIVAFSENAPEMLEVAAGLGTDLRMLFTQGSTAALDQAVKEEDLSSVNPLVLQSCGGSAKQFYAMLHRIEDVAGVVIDLEPIENGVVEKKSSAEMAVKPIARVQSLPGGEIGRLCQVVVEEVQEMTGYDRVMAYKFHEDGHGEVVAEVRRPDLEPYLGLHYPSTDVPQASRMMFMKNGVRMIGDCTLPPVRVVQAKELAQPISLAGSTLRAPHGCHAQYMSNMGSAASLTMAVAIDDYDDDSSLSCGSRKLWGLVVCHHPSPRTVSYPLRCACEKLMVAFGVQLNIELDLAAQLRENHILTTQALLCDMLRRIRGAPIGIVSRSPSIMDLVKCDGAALYYGGRFWPLGTTPSEFQIRDLAEWLLGASEEIASTGVTCTDSLAEMGYPGAALLGDAVCGMAAAMITPNSDFLFWFRSHTAKEVYWGGAEHDPQSRDDDSWMQLPRSSFKAFLEIVKRRSLPWEEVEVDAIRSLQLILREDLEQFCAAVGAVKASDGDDEDSLVPSAKKLSLKETEENGGADNSKKLERMHSAAAGGGGGGGRWEKMRLPSSLAQEWMEAIRGTGDGGASGGGGGGPFDWDLISAFQHNSFIVVDALKPDFPIIYASTGFFNLTGYTSREVIGGNCRFLQGPDTNPADVASIREALAQGTGTFCGRLLNYRKDGSSFWNLLTIAPIKDDLGSIVKLIGVQLEVSKYTEGIRANNRRPNGMPQSLIRYDVRHQDKVSAFIAQLVAALTKPDKVETPRLSSAMRFSLTGQTIESLPQPTAIPREGGGRTRRPRSSSFLSLLGMEKEKDIPEEDELQELEVIMLEDASVGRPGSLDDPERTRRGIDLATTLERIGKSFVITDPRLPDNPIIFASDRFLELTEYTREEVLGNNCRFLQGRGTDRKAVQLIRDAVKEQRDVTVQVLNYTKGGRAFWNLFHLQVMRDENGDVQYFIGVQQEMVAPRPVHQPPELPDILPDRVEQEKAEVVRATAQRVDAAARELPDANLVPDHLFAPHSKVVTPLPHSKTNSSSWFAIRRVQRRLRRGERLGLKHFRPIKPLGSGDTGSVHLVELRGTGQVFALKAMDKSMMLQRNKVHRARAEREILAIMDHPFLPTLYASFQTKTHVCLITDYCPGGDLFLLQDKQPTQTLSERTASFYAAEVVVALEYLHCMGVIYRDLKPENVLLQKNGHILLTDFDLSFLTSCRPQLILQGGKGRSRRSKRRRRVTFCAEPRVSSNSFVGTEEYIAPEIISGEPHSSAVDWWALGILLYEMLYGRTPFVGRNRQKTFYNVLNKELIFPTSIPVSLAGRQLIAGLLQRDPTIRLGTLRGASELKKHPFFREINWPLIRWRKFSANQAHNANNVSSLDEGESDSGNAWEANGGSTQSFQDTF

SEQ ID NO: 20299 - protein, 360 aa, Pseudomonas syringae pv. tomato str. DC3000
MSKQILILPGDGIGPEIMTEAVKVLELANQKYQLGFELTHDVIGGAAIDKHGVPLADETLDRARAADAVLLGAVGGPKWDTIERDIRPERGLLKIRSQLGLFGNLRPAILYPQLADASSLKPEIVAGLDILIVRELTGGIYFGAPRGTRVLDNGERQAYDTLPYSESEIRRIAKVGFDMAMVRGKKLCSVDKANVLASSQLWREIVEQVAKDYPEVELSHLYVDNAAMQLVRAPKQFDVIVTDNLFGDILSDQASMLTGSIGMLPSASLDTANKGMYEPCHGSAPDIAGQGIANPLATILSVSMMLRYSFNLTAAADAIEQAVSLVLDQGIRTGDIWSEGKVKVGTKEMGDAVVAALRNL

SEQ ID NO: 20300 - protein, 403 aa, Triticum aestivum
IRHEEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 20301 - protein, 172 aa, Glycine max
  unsure (1)..(172): unsure at all Xaa locations
AYSMISSPTVTNVNPACAGMVAPFTGLKSIAGFPTRKTNNDITSIATNGGRVXCMHVWPPVGKKKFETLSYLPDLDDAQLAKEVEYLLKNGWIPCLKFELEHGFVYREHNRSPGYYDXRYWTMWNLPMTCCTDAYDVFKELQXANTAIANSFIQIIRFDNLLSVQCMSFDRY

SEQ ID NO: 20302 - protein, 348 aa, Rosa hybrid cultivar
NQKWSNGEHSNELLHAQAHIWNHIFSFINSMSLKSAIQLGIPDIINKHGYPMTLSELSSALPIHPTKSHSVYRLMRILVHSGFFAKKKLSKIDEEGYTLTDASQLLLKDHPLSLTPFLTAMLDPVLTKPWNYLSTWFQNDDPTPFDTTHGMTFWDYGNHQPNIAHLFNDAMASDARLVTSVIIDDCKGVFEGLESLVDVGGGTGTVAKAIADAFPHIECTVLDLPHVVGDLQGSKNLKYTGGDMFEAVPPADTVLLKWILHDWNDEECIKILKRSRVAITSKDKKGKVIIIDMMMENQKGDEESIETQLFLDMLMMALVGGKERNEKEWAKLFTDAGFSDYKITPILG

SEQ ID NO: 20303 - protein, 288 aa, Neisseria gonorrhoeae
MKGIILAGGSGTRLYPITRGVSKQLLPVYDKPMIYYPLSVLMLAGIRDILVITAPEDNAAFQRLLGDGSDFGIRLQYAVQPSPDGLAQAFIIGEEFIGNGNVCLILGDNIFYGQSFTQTLKQAAAKTHGATVFGYRVKDPERFGVVEFDENFNALSIEEKPQQPKSDWAVTGLYFHDNRAVEFAKQLKPSARGELEISDLNRMYLEDGSLSVQILGRGFAWLDTGTQESLHEAASFVQTVQNIQNLHIACLEEIAWRNGWLTKKDVETRAKHLEKTAYGQYLLHLIGK

SEQ ID NO: 20304 - protein, 146 aa, Capsicum annuum
MLSAKKLIKMARRWQKFAAKQRKRISFPRNNSNADGCSTPSSSIVEKGHFVVYTIDQTRYVFPLTYLENEVVMQLLNMSEEEFGLPSGGPITLPCDSSFMDYIISLIKKGVAAEDLHNAILLSIPSCCCSTSSCHQESGNQQIFVC

SEQ ID NO: 20305 - protein, 307 aa, Oryza sativa (japonica cultivar-group)
MAMKRLSFSLFLLPFLLLAFVYSLFFPGYFSILPSLAARCSNSVAATPANATGPAVDLRVLLGVVTRAEMYERRALLRLAYALQPAPARAVVDVRFFVCSLAREEDAVLVSLEIIAHGDVVVLNCTENMDDGKTHSYFSSLPALFADAPYDYVGKIDDDSYYRLASLADTLRDKPRRDLYHGFPAPCHADPRSQFMSGMGYIVSWDVAAWVAATEALRGDVKGPEDEVFGRWLRRGGKGSNRYGEETRMYDYLDGGMREGVNCFRHALVADTVVVHKLKDRLKWARTLKFFNATQGLKPSKLYHVDL

SEQ ID NO: 20306 - protein, 577 aa, Eremothecium gossypii
MFSGRGNNVRDVDALAQDIGQLSFEGEMENRRHIVIDPPHTPSRYLQRTPNGKSPAGRQGGYLTVENADYSGMDVDERPRDDIDLSRSPKKLPMDFHKRASSTKTKRLVSVCQMFFLDYYCDMFDYVISRRERTRQVMNYLEQQRAQGLHSAQEISEEWQNYLYRETDILRKRRLKPKNKDFEIITQVGQGGYGQVYLARKKDTKEICALKILNKNLLAKLNGTDHVLTERDILTTTRSEWLVKLLYAFQDPHSLYLAMEFVPGGDYRTLLINTRFLQAPHARFYISEMFCAVDALHKLGYTHRDLKPENFLIDSKGHIKLTDFGLASGTVSMERIESMRIRLEEVKNLEFPEFKETSMDYRRKMYHRVREKELNYASSTVGSPDYMALEVLEAKNYDFTVDYWSLGCILFESLVGYTPFSGSSSNETYENLRRWKQVLRRPRCENGRPAFSDRTWELITRLIADPINRLRSFEHVKKMKYFAEIDFANLRSMSPPFIPQLDSETDAGYFDDFTNEADMAKYADVFKRQDKLNAMVEESSNSSKLVGFTFRHRKGKTGSSGVLHNGSEHADPFATFY

SEQ ID NO: 20307 - protein, 299 aa, Bacillus anthracis str. Ames
MTRTYILLFICVVVWGSNFIFGAILVNTFHPVLLTTLRLLFINLFFLAYAIMCKKDLYIEKSEMKSVLLIGIIGVAINQWSFYEGLQTADPTTAALILALTPVMTSILAVFILNEPLTAKLVIGGGIATFGVFFVIGVGQRFVFSEGLIWIFITMLSFSLSIVLIRKLGNRDDMFFITFFSSIFGFLIMLPFLAFTFSHITLKYSIESWSLLIVTAILMHGICTLVWNNQLRKAQASTAAMFLNLEPFVTMVVGYIILQKSVTAIQIIGAVFIVCGVYTATFGYGKKSKGQKELFRKAT

SEQ ID NO: 20308 - protein, 804 aa, Leptosphaeria maculans
MKIHSPRDLSYPITVVDLLKKPGEDIKRSEKLFSYRYETDVTEGDKWGGWETKKKKLITKYDSSAAGQVTRWLISPGTVIDRQGVPLVEIEEPCTHETQFGGLCAECGEDMTKIDYLTKERDVARATINMTHDNVALLVSQKEANAAEEDAKKRLLGAKKLTLIVDLDQTVIHTTCERTIAEWQADPENPNHGAVKDVEGFQLADDNVSNVAANWYYVKKRPGLEDFFKRMSKLYEMHVYTMATRAYAQAVCKIIDPDRRYFGDRILSRDENYTDKTKSLSRLFQNTTMVVIIDDRADVWQYSPHLVRVPVFNFFPGAGDINASFLPKQQELVSFAKDKLPPTPKKSDGTPLCAMSVAGQPAEPALVAVSNGDLKDIGEKLVNLAKKEDLEVQAKEQEKVIIAQQTERPLLQQQLLQDKEDEAAEEVEAPGDVIANGTPQHADHHKIRHSILNNDDRGLDVIEQNLVRVHREFYDQYVRSKAVPAGGRIAELKGEKSPKKRAMNDVVPDVAEIMPRIKSEVLDGAVVVFSGIIPLGVDVQSSDFALWIMSFGAEVSTTVNRRTTHVIANPDRKTTKVKSAARYPHIKIVNPEWMFQCCTRWEHVDEGPYTIEIDPAEREGSPFGDLDDESISATGDEADEDDDATVRLDAMTADSWASVDDELADFLNESETDGGSDSDSESVRSDTSTTSDVKEQKKKRKRTSTNSTDGSDAEESDSSVTSTSRLQRRKKRTLERVTSLTNVVTAEKSSGLPSPETTGPEEGQNEDEEKASEVNGSAPDLQEDYDDGLEAELLAGFDDSDGDD

SEQ ID NO: 20309 - protein, 496 aa, Triticum aestivum
  unsure (1)..(496): unsure at all Xaa locations
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSARDDPRTRAGSPVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKAHYVKFHWXRPTCGVSCLMDDEATLVGGKNHSHATQDLYDSIDAGNFPEWKLFVQVIDPDDEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFADALARPKVSHELRVIWIDFLSKCDKSCGMKVANRLNVKPSM

SEQ ID NO: 20310 - protein, 125 aa, Triticum aestivum
  unsure (1)..(125): unsure at all Xaa locations
MAVSTELPEAGSPQEQGTEATAPPPPGLRYNSPLVQVSLIGLVCFCCPGMFNALSGLGGGGQLDHTTADNANTALYACFAIFGVLGGAAHNLLGPRLTLLLGSLTYPLYAASFXYYNHRKSQTFP

SEQ ID NO: 20311 - protein, 523 aa, Apium graveolens var. dulce
MAGAFNVSGDDSGGSKDVGSPVIFDAVKKPKRNKYAFGCAILASMTSVLLGYDIGVMSGAAIYIKDQLHVSDVKLEIVVGIINFFSLVGSALAGRTSDWIGRRYTMVLAGAIFFVGAILMGFATNYSFLMFGRFVAGIRSRLCPHDCSGVHGRGFFSIISWISYFIPGSFINIGVLLGYVSNYAFSKLPANLGWRFMLGIGAIPSIGLAIGVLGMPESPRWLVMKGRLGEARQVLDKTSDSKEESRLRLSDIKQAAGIPEECNDDIVVMPKRRNDEAVWKELLLHPTPSVRHAFIAGVGLHFFQQSSGIDAGGLYSPRIFEKAGITSTDLKLLATIAVGISKTLFILVATFLLDRIGRRPLLLTSMGGMIISLTLLGTSLAVIATQITQFIGPGHWQSSEVYHTWAVFFWLGPIAWGYSSEVFPLRLRAQGCSIGVAVNRGTSGIISMTFLSLYKAISIAGAFYLFAAIAGVAWIFIFTLLPETQGRSLEEMGLLFGTYFGWRKTLKGLKNREAEEAKNANVI

SEQ ID NO: 20312 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 20313 - protein, 172 aa, Zea mays
RRIETQLNMLCNGPVRIFSDDKCEGVGSSEEDQDNSGGETELPEIDPRAEDRELKNHLLRKYSGYLSSLKQELSKKKKKGKLPKDARQKLLNWWELHYKWPYPSESEKVALAESTGLDQKQINNWFINQRKRHWKPSEDMQFMVMDGLHPQNATLYMDGHYMAADGHYRLGP

SEQ ID NO: 20314 - protein, 543 aa, Triticum aestivum
  unsure (1)..(543): unsure at all Xaa locations
HAPPSPPIVGRHLLSCPDDMAFEGAYHFLQLAVGHATSSPAALLLVVVPLLLLLLASVRRSTMTGRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFANGRQEEVCLVVXKIREAATTAPSPAGDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKKLDMITEEDLSSLPYLKATMKEALRLHPPGPLLLPHYSTADCSIDGYDIPAKTRILVNGWAIGRDPKAWERPEEFMPERFLQDGQEKSSNLGQDFKYLPFGSGRRICPGANFALATMEIMLVNLMYHFDWEVPNEKDGAGGKVSMAETFGLMLRRNEKLYLVPRIA

SEQ ID NO: 20315 - protein, 1030 aa, Glycine max
  unsure (1)..(1030): unsure at all Xaa locations
MAWFRAGASIAKHAIRRTLSKGGSTHLVSRARVLPSIPSSSSSPYSRSFHSSVFKEQAAPVPRAVPLSKLTDSFLDGTSSVYLEELQRAWEADPNSVDESWDNFFRNFVGQATTSPGISGQTIHESMRLLLLVRAYQVNGHMKAKLDPLNLEPREIPEDLDPALYGFTEADLDREFFLGVWRMAGFLSENRPVQTLRSILTRLEQAYCGSIGYEYMHIAXDRHKCNWLRDRIETPTPTQFNRERREAIFDRLAWSSLFENFLATKWTSAKRFGLEGGETLIPGMKEMFDRASDLGVESIVIGMAHRGRLNVLGNVVRKPLRQIFCEFSGGLQPEGEVGLYTGTGDVKYHLGTSYDRPTRGGKRIHLSLVANPSHLEAVNPLVIGKTRAKQYYANDVDRTKNMGVLIHGDGSFAGQGVVYETLHLSALPNYTTGGTIHIVFNNQVAFTTDPTSGRSSQYCTDVAKALDAPIFHVNGDDVEAVVHACELAAEWRQTFHSDVVVDLVCYRRFGHNEIDEPSFTQPKMYKVIRSHPSTLEIYEKNLLESGELTQEEIDRIHKKVTSILNEEFLASKEYIPKRRDWLSAYWLGFKSPEQLSRIRNTGVKPEILKTVGKAITTIPENFTPHRAVKRIYEQRAQMIETGEDIDWGFAEALAYATLLIEGNHVRLSGQDVERGTFSHRHAVVHDQTTGEKYCPLDHVIMNQDEEMFTVSNSSLSEFGVLGFELGYSMENPNSLIIWEAQFGDFANGAHVIFDNFLASGEAKWLRQTGLVVLLPHGYDGQGPEHSSARLERFLQMADDNPHVIPEMDPTLRKQIQECNLQIVNVTTPANFFHVLRRQVHRDFRKPLIVMSPKNLLRSKACRSNLSEFDDVQGHPGFDKQGTRFKRLIKDQNAHKDVEEGIRRLVLCSGKVYYELDEQRTKVDANDVAICRVEQLCPFPYDLVQRELKRYPNAEVVWCQEEPMNMGGYTYVLPRLISSMKAVNRGGYDDVKYIGRAPSAATATGFLKVHQKEQTEIAEKAVQQEPIDFPF

SEQ ID NO: 20316 - protein, 193 aa, Phaseolus vulgaris
MVPSEIRGVNYLAPENPFLVPPNFGLLQNDIPNLHLNTLLSNFPNCHFPPSGLEFVAPHSCLSSNSTSDEADEIQFNIIDERKHRRMISNRESARRSRMRKQKHLDELWSQVVRLRTENHNLIDKLNHMSDSHDRVLQENTRLKEEASDLRQMLADMQIGTSFACTMEELEDLPCNKPGPSNQLITPADMIHE

SEQ ID NO: 20317 - protein, 359 aa, Bradyrhizobium japonicum USDA 110
MKDTYTIAVVHGDGIGPEVARAAVAVLQAGVQAGTLRFVDYPAGADHFLKTGDSFPAASFEGCRTADAILHGAAGIPGVVHPDGTEAGLDFTLTLRFKLDLFANVRPIKLYKGVPSPLGRPGPIDYVIVRENSEGLYAARGAGALLREEVAVDTLVQTRKGVERIVRFAFELARTRNGSPKDGRRRVTCCDKANVLRTYAFFRAVFDEVAKEYPDIEAEHVLVDAMTVHLVNKPTHFDVIVTENMFGDIISDLGAATVGGMGMAPSEEVGDGIGFFQASHGSAPDIAGKGLANPYGTILASILMLRRLDQRHRDSRLKLGADRIEAAVCAGLEDPALRTRDIGGVAPTNQVVDALLKRL

SEQ ID NO: 20318 - protein, 487 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVA

SEQ ID NO: 20319 - protein, 377 aa, Archaeoglobus fulgidus DSM 4304
MSEVEQFATIALISLTAFISPLIADKLRVPVVVLEIVLGMIFGVSFLNVIYASEWLSFLSLFGLIFLMFLAGLEIDADVVLKSGHLKRVVAFFALSLALSVALTALMGLNLFYAIILTNVAVGVVVSVLREIGLEKEDFGQLNIVTALVSDFSTMFLLSIYFITGYLQVAFAFLIILVFLAAYRFGKLVIWHFPDFISRWFSDEPSEIGVRGSLAIMILFVGLSSLLGVEAILGAFLAGVLLSITFRGGKKLYDKLYGMGFGFFIPIFFIKTGSELNITQAGEGIGFILLLLAVSVAVKGIPSLIFASNFGLRRAISMGMLQSTKLSLTIAGVAIGVSSGVITEFESTALVTFTIISCLLSPTLFRFLYPRYLPKTR

SEQ ID NO: 20320 - protein, 474 aa, Pseudomonas fluorescens PfO-1
MQTKLLINGQLVNGEGPAQPVLNPARGEVLVEINEATEAQVDAAVRAADSAFAEWSQTTPKDRSLLLLKLADAIEAHGEELAKLESDNCGKPYNAALNDEIPAIADVFRFFAGASRCMSGSAGGEYLPGHTSMIRRDPVGVIASIAPWNYPLMMVAWKIAPALAAGNTVVLKPSEQTPLTALRLAELASDIFPAGVLNLVFGRGPSVGSPLVTHPKVRMVSLTGSIATGSNIISSTADSVKRMHMELGGKAPVIIFDDADIDAAVEGIRTFGFYNAGQDCTAACRIYAQQGIYDKFVEKLGAAVSSIKYGLQDDPSTELGPLITAQHRDRVAGFVERAVAQPHIRLITGGKAVDGNGFFFEPTVLADAQQDDEIVRREVFGPVVSVTKFTDEAQALEWANDSDYGLASSVWTADVGRAHRLSARLQYGCTWVNTHFMLVSEMPHGGQKLSGYGKDMSMYGLEDYTTVRHVMFKH

SEQ ID NO: 20321 - protein, 549 aa, Triticum aestivum
MAAAATRRAASSLASRCLLARPAASPAAVPSALRRADGARGLLPGLLQRFGTAAAAEEPISPSVQVGETQLLINGKFVDAASGKTFPTVDPRTGEVIARVAEGDAEDVDRAVVAARKAFDEGPWPRMTAYERSRILLRFADLIEKHNDDIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTVWVNCFDIFDAAIPFGGYKMSGIGREKGIDSLKNYLQVKAVVTALKNPAWL

SEQ ID NO: 20322 - protein, 295 aa, Buchnera aphidicola str. Bp (Baizongia pistaciae)
MKLVYKNYHETLNQHLMNICEKVNISFEFFPPNNILSEKNLWQVIDKLKLLTPKFFSVTHGTNSKIRATCTSNIVKKIKKYTGIETVPHLTCINSTEEELKVIAKTYWDSGIRHILALRGDIFNTNCKPKIYAVDLIKLLKSIANFEISVAAYPEVHPEAVNAKYDIINLKRKVEAGATRAITQFFFNIDCFLRFRDLCVKNNITIDIVPGIFPISNFKQLLKFSSVSNVSIPKWLCCMFHGLDNDLNTSRIIGSSIAIDMVKVLYSEGIRSFHFYTLNKSEISFAICKILENKS

SEQ ID NO: 20323 - protein, 323 aa, Mangifera indica
MESLSFPVINLEKLNGEERAATMEKIKDACENWGFFELVNHGIPIEELDTLERKTKEHYRKCMEQRFKELVASKALEGVQTEIKDMDWESTFYVRHLPQTNLKCTPDLDDEYRKVMKEFASKLEKLAEELLDLLCENLGLEKGYLKKTFYGSKGPTFGTKVSHYPPCPQPDLIKGLRAHTDADGIILLFQDDKVSGLPASERWAVDIDVPPMRHSIVVNLGDQLEVITNGKYKSVEHRVVAQRDGNGRMSIASFYNPGSDAVIYPAPPLLEPEAEEKKQVYPKFVCEDYMKLYARLKFQAKEPRFEAMKAVETTVNLGPIATA

SEQ ID NO: 20324 - protein, 599 aa, Saccharomyces cerevisiae
MKITEKLEQHRQTSGKPTYSFEYFVPKTTQGVQNLYDRMDRMYEASLPQFIDITWNAGGGRLSHLSTDLVATAQSVLGLETCMHLTCTNMPISMIDDALENAYHSGCQNILALRGDPPRDAENWTPVEGGFQYAKDLIKYIKSKYGDHFAIGVAGYPECHPELPNKDVKLDLEYLSRRSTGGDFIITQMFYDVDNLLNWCSQVRAAGMDVPIIPGIMPITTYAAFLRRIQWGQISIPQHFSSRLDPIKDDDELVRDIGTNLIVEMCQKLLDSGYVSHLHIYTMNLEKAPLMILERLNILPTESEFNAHPLAVLPWRKSLNPKRKNEEVRPIFWKRRPYSYVARTSQWAVDEFPNGRFGDSSSPAFGDLDLCGSDLIRQSANKCLELWSTPTSINDVAFLVINYLNGNLKCLPWSDIPINDEINPIKAHLIELNQHSIITINSQPQVNGIRSNDKIHGWGPKDGYVYQKQYLEFMLPKTKLPKLIDTLKNNEFLTYFAIDSQGDLLSNHPDNSKSNAVTWGIFPGREILQPTIVEKISFLAWKEEFYHILNEWKLNMNKYDKPHSAQFIQSLIDDYCLVNIVDNDYISPDDQIHSILLSL

SEQ ID NO: 20325 - protein, 220 aa, Glycine max
  unsure (1)..(220): unsure at all Xaa locations
MAHFTSSGKSDDLTKEDCKGQSALVVCFGEILIDFVPTVGGVSLAEAPAFKKAPGGAPANVAVGISRLGGSSAFVGKVGADEFGYMLADILKQNDVETSGMKFDPNARTALAFVTLRADGEREFLFFRNPSADMLLQESELDENLIKKAKIFHYGSISLIDEPCKSAHPAAMRXXKESGCIPFRNDPKFENWHLMGPSGWKAGSGMGNKWSYGGSKAGLF

SEQ ID NO: 20326 - protein, 216 aa, Thermoanaerobacter tengcongensis
MKFFLDTANIEEIKEAYSLGVISGVTTNPSLVAKEGRDFKEVIREIAEIVDGPISAEVISDDHEGMVKEARELAKIHKNIVIKIPMTAEGLKAVNILSKEGIKTNVTLIFSANQALLAARAGATYVSPFVGRLDDINTDGMQIIEDIVTIFTNYDIQAEIITASVRHPIHVLEAAKLGAHIATVPYKVLMQMIKHPLTDIGIERFKEDWKKAGLKI

SEQ ID NO: 20327 - protein, 318 aa, Haemophilus somnus 2336
MMSKTLTVLGSINADHVISVPHFAKPGETLSGKQYHIAYGGKGANQAVAAARLADFSQGATVNFVGCIGSDDIGRAMKKAFAQDGINVATITEIPNEMTGIAMIQVADSGENSIVISAGANAYLTPEIVDKFATEIERADYLLMQLETPLNAILEAAKLAKKHGATVVLNPAPANQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 20328 - protein, 176 aa, Leuconostoc mesenteroides subsp. mesenteroides ATCC 8293
MTVDLHDFVATVEDYPEPGVSFRDISPLMGDGVAYKQAVDAIADFAKHLNVDLIAGPESRGFIVGSPLAYAMNIGFVPARKGGKLPREAVSASYTLEYGGVNELEIHKDAIKPGQRVLIVDDLLATGGTINATREIIEKLGGIVAGVAFIIELESLQGREKIMKAGEVPFLALMEY

SEQ ID NO: 20329 - protein, 272 aa, Glycine max
MAVADPKPHSEPKVWNFFKLPFRHSAATNTTPSSANLHHLHHHHNHHHHHHHHHNPNNLPLEGSTSHTSNSVSSVARSLLPTRRRLKLDPSNKLYFPYEPGKQVRSAIRIKNTSKSSVAFKFQTTAPKSCFMRPPGAILAPGESIIATVFKFVEQPENNEKPEKSGLKFKIMSLKVKGSIDYVPELFDEQKDQVAVEQILRVVFLDPERPCPALEKLNRQLADADAALEARKKPAEDAGPKIIGEGLVIDEWKERRERYLAKQQGEVVVDSV

SEQ ID NO: 20330 - protein, 167 aa, Triticum aestivum
  unsure (1)..(167): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRFKWVPCLEFSKVGFIFREHNAXPGYYNGRYWXTMWKLPMFGMHRPTQVIXQVEEVKKEYXDAYVRIIGFDNIVRCMRQLIASSNG

SEQ ID NO: 20331 - protein, 511 aa, Zea mays
LLVVPLLLLLLSPLLCLLSSGRRRRREQGAAERRRAPPGPPKQLPVLGNLLQVGSRPHRYFQAVARRYGPIVEVQLGRVRTVVVSSPDAAKEVLRTNDLHCCSRPNSPGPRMLSYDFLDVAFSPYSDYWREMRKLFILELLSMRRVQSFAYARAAEVDRLVSSLASTPPGAAVDLSEKLYALSDGVVGTVAFGKMYGSAQFERSSFQRVMDETLRVLGSFTFEDFFPASRLARFADVLTGAAGRRSRIFRQIDRFFDSVIDKHLEPERLQAGVQEDMVDALVKMWREEQADGYEAPHGLTRDHIKGILMNTFAGGIDTCAVTMIWIMAELMRNPRVMQKAQAEVRTLVGNKPRVDEEDVKSLSYLKMVVKENFRIHPPGTLLIPRETMRSCVIGGYDVLPGTRIFVNVWAMGRDASIWDRPEEFSPERFEGSHVDFRGSSFELLPFGSGRRSCPAIAMGVANVELVLANLLHCFDWELPDGMVEEDIDMEETGQLAFRKMVPLCLVPIKRV

SEQ ID NO: 20332 - protein, 292 aa, Oryza sativa
SWIGKVSDKKGGASDVAVVVAAPPFNASSVTIISWKPRIFFYKGFLSDDECDHLVKLGKEKLKRSMVADNESGKSVMSEVRTSSGMFLDKQQDPVVSGIEERIAAWTLLPQENAENIQILRYENGQKYDPHFDYFQDKVNQLQGGHRYATVLTYLSTVEKGGETVFPNAEGWESQPKDDSFSDCAKKGLAVKAVKGDSVLFFNLQPDGTPDPLSLHGSCPVIEGEKWSAPKWIHVRSYDNASSMKQSEECSDLSENCAAWAASGECNNNAVYMIGTEDAPGQCQKSCNACSL

SEQ ID NO: 20333 - protein, 362 aa, Pseudomonas fluorescens PfO-1
MTSALKSFVPGALALLLLLPTALQAKEAETQTKLANVVVLATGGTIAGAGASAANSATYQAAKVGIEQLIAGIPELSTLANVRGEQVMQIASESITNENLLQLGRRVSELADSKDVDGIVITHGTDTLEETAYFLNLVEKTDKPIIVVGSMRPGTAMSADGMLNLYNAVAVASSKEARGKGVLVTLNDEIQSGRDVSKMINIKTEAFKSAWGPLGMVVEGKSYWFRLPAKRHTMDSEFDIKNIKSLPDVEIAYSYGNVSDTAYKALAQSGAKAIIHAGTGNGSVSSRVVPTLQALRKDGVQIIRSSHVNAGGFVLRNAEQPDDKYDWVVAHDLNPQKARILAMVALTKTNDSKELQRMFWEY

SEQ ID NO: 20334 - protein, 787 aa, Oryza sativa (japonica cultivar-group)
MSEGGHWRSYYRHVLLLAYQSCGVVYGDLSTSPLYVYKSTFIIGSLRRFQDEEIVFGVFSLVFWTLTLIPLLKYVFIVLAADDNGEGGTFALYSLLVRHAKFSLMPNQEAADEELTSYYRPGYAPQETPILTALRRFLENHRKSRTFLLVTVLFGASLVIGDGVLTPPMSVLSSFSGLQVHSTALTSGEVEILSCTVLVCLFMVQHWGTHRVAFLFAPVVIVWLLLLGALGVYNIVVWNPRVLRALSPYYLVRFFQHTGKDGWISLGGILLSMTGTEAMYADLGHFTAASIRVAFVGLIYPCLVLQYMGQAAFLSKSPHCDIHFVFFESIPTGIFWPVLVIATLAAIVGSQAVISATFSIVRQCTALGCFPRVKIVHTSRRIHGQIYSPEINWILMLLCIAVTMGLRDTTLIGNAYGMACAGVMLVTTLLMALVIVFVWQYSCLVAALFLVAFGVVEAVYLSAALMKVPQGGWLPLVLSLVFVAVMYVWHYGTRRKHQFDVQNKVSLRWIHALGPSLGIVRVPGIGIIYSELATGVPAIFSHFVTNLPAFHQVLVFICVKAVPVPHVRDEERHLVGRIGPREFRMYRCVVRHGYKDVLAEDTDFENDLVLRIAEFVQMEADFDQRCSISDDGVVASVEVEGRMAVVPRPSDLARTGLLMREPGEEESVVARAAAAAKPESLIHSMHTMHEAESPGFASRRRVRFEVANQHTDPRVKEELSALVEAKHAGVAYIMGHSYIKARKSSSVFKKFAVNVAYAFLRKNCRGPGLVLNIPHISLIEVGMIYYV

SEQ ID NO: 20335 - protein, 251 aa, GIBBERELLA ZEAE PH-1
MSRRYDSRTTIFSPEGRLYQVEYALEAISHAGTAIGILAKDGIVLAAERKVTSKLLEQDTSAEKLYILNDNMICAVAGMTADANILINYARQAAQRYLLTYNEDIPCEQLVRRLCDLKQGYTQHGGLRPFGVSFIYAGWDPRRQFQLYLSNPSGNYGGWKATSAGANNASAQSLLKQDYKEDCTLKEACGMAVKVLSKTMDSTKLSSEKIEFATVGQTEDGKIYHRLWSADEITALLKEHDLAKNEETEEK

SEQ ID NO: 20336 - protein, 302 aa, Streptomyces coelicolor A3(2)
MIVVAGEALIDLVPQGTGALAALRPALGGGPYNTAVALGRLGSPVAFCSRVSYDGFGEALLDRLRETGVDVSPVQRGAEPTTLAVASLDADGSAAYSFYVEGTADRMFALPAALPSGTRAVSFGTCSLVLEPGASAYEELLRETAARGVFTALDPNIRAGLIPDPDAYRARFKSWLPSVSLLKLSAEDAEWLGGTPREWLAAGPAAVVVTRGGDGLTAFTRDGGEYTVPGERVEVVDTIGAGDTVNAALLHGLAARGALRDADLAALGPDGWAGLLGFAARAAAVTCSRAGAEPPYAHEVAA

SEQ ID NO: 20337 - protein, 308 aa, Salmonella typhimurium LT2
MARAMDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATSGMYQNAGEFAWRVGLPAKSGVGGGIVAIVPHEMAIAVWSPELDPAGNSLAGIAALEQLTQTLGRSVY

SEQ ID NO: 20338 - protein, 157 aa, Zea mays
MAAAAAAPASVAPSSAPKAAGDNRKTVVSVDASELEKHVLAVDDSSVDRAVIARILRGSRYKVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 20339 - protein, 429 aa, Nostoc punctiforme
MSKFLDTAIEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 20340 - protein, 400 aa, Zea mays
  unsure (1)..(400): unsure at all Xaa locations
MALRLNDVALCLSPPLAARRRRRSGGSFVAVASMTSAAVSTRXGGKKPFAPPREVHVQVTHSMPSHKIEIFKSLDDWARDNILTHLKPXVEKCWQPQDFLPDPASEGFHDEVKELRERAKEIPDDYFXVCLVGDMITEEALPTYQTMLNTLDGVRDETGASPTAWAVWTRAWTAEENRHGDLLNKYMYLTGRXVDMRQIEKTIQYLIGSGMDPRTENNPYLGFIYTSFQERATFISHGNTARHXAKDFGDLKLAQICGIIASDEKRHETAYTKIVEKLFEIDPDGTXVVALADMMRKKISXMPAHLMFDGQDDKLFEHFSMVAQRLGVYTARDYADILEFLVDRWKVASLTGLSGEGNKAQDYLCTLASRIRRLEERAQSRAKKAGTLPFSWVYGRDVQL

SEQ ID NO: 20341 - protein, 571 aa, Buchnera aphidicola str. APS (Acyrthosiphon pisum)
MEILSGAEMVVRSLIDQGIQHIFGYPGGAVLDIYDALKTVGGIEHILVRHEQAATHMADGYSRSTGKTGVVLVTSGPGATNAITGIATAYMDSIPMVVISGQVASSLIGYDAFQECDMIGISRPIVKHSFLVKKTEDIPIVFKKAFWLASSGRPGPIVIDLPKDILKKDNKYLYKWPDNINIRSYNPTTKGHIGQIKKALHTLLKAQRPVIYAGGGIISSNSSEELRIFAEKINCPVTTSLMGLGSFPGTHDQNISMLGMHGTYEANMTMHHADVIFAIGVRFDDRTTNNLNKYCPNAIVLHVDIDPTSISKTVSANIPIVGDAKHVLQKMIELLKKEKKISLLEDWWNTIKKWKKINSLQYNQLSNKIKPQTVIKTLFKLTKGTSYITSDVGQHQMFTALYYPFNKPRRWINSGGLGTMGFGLPAALGVKLALPKETVICITGDGSIQMNIQELSTARQYNLAVLILNLNNSSLGMVKQWQDMIYSGRHSHSYMDSLPDFVKLSESYGHFGIQITEPIELEEKLMLALSKLSDGHLVFVDVQIDNSEHVYPMQIQGGGMNEMRLRKKEVA

SEQ ID NO: 20342 - protein, 268 aa, Xanthomonas axonopodis pv. citri str. 306
MQQQTVVLITGVSSGIGRAAAEHFARTGCIVYGSVRHLAGATPLTAVELVEMDIRDAASVQRAVDGIIARAGRIDVLVNNAGANLVGAIEETSVDEAAALFDINVLGILRTVQAVLPHMRARGQGRIVNVSSVLGFLPAPYMGVYAASKHAVEGLSETLDHELRQFGIRVTLVEPAYTKTSLGSNSPAAQATIADYDRERGVVARTVTHSIDTAPEPHGVAATVVEAALGRWRMRRTPAGQASLLSKLRRFLPASAVDGSLRKQLGLR

SEQ ID NO: 20343 - protein, 337 aa, Zea mays
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYGDIKKAIKAASEGPLKGIMGYVEEDLVSTDFVGDSRSSIFDAKAGIALNDNFIKLVSWYDNEWGYSNRVVDLIRHMFKTQ

SEQ ID NO: 20344 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 20345 - protein, 549 aa, Escherichia coli O157:H7 EDL933
  unsure (1)..(549): unsure at all Xaa locations
MEIFFTILIMTXVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 20346 - protein, 661 aa, Bacillus cereus ATCC 14579
MEQLKHHVTDNQRKHALTTNQGVKIAEDEFSLKMGLRGPTLMEDFHFREKMTHFDHERIPERIVHARGVGVHGYFQLYESLEAYTKADFLTNPSKKTPVFVRFSTVQGSKGSNDTVRDVRGFATKFYTDEGNYDLVGNNMPVFFIQDAIKFPDFVHAVKPEPHNDIPQGASAHDTFWDFVAHNPESTHMVMWQMSDRAIPRSLRMMEGFGVHTFRLINTAGKAHFVKFHWKPTLGVHSLVWDEAQRIAGKNPDFHRQDLYEAIEKGDYPEWELGLQLIPEEDEHKFDFDILDPTKLWPEEEVPVKLVGKMTLNKNVDNFFAETEQVAFHPGHVVPGIDFSNDPLLQGRLFSYTDTQLSRLGGPNFHQIPINQPVCPFHNNQRDGMHQMQIHRGQTSYHPNGLNNNQPATVQAEQGGYEHYQEKIDGHKIRGRSKSFLNFYSQAKLFYNSMSPIEKQHIKEAFCFEVGKCKSDMVKANVIALLNHVDRQLAQEVANIVGAPLPKENHEVNSDAKSPALSMSNTIFKSDSKNVAILLNGDPSVSLLSEWIQAFAQHRMNYSIIDNKIYHFNDSIKVTDTYTTTDSSLFDAVLVFSSESVIHPPVLEFTETTFKHFKPIAHVLSNPHALDNSKIKLDGAGVYNLTNTSIESFIEGIAQGRFWNR

SEQ ID NO: 20347 - protein, 467 aa, Pseudomonas putida KT2440
MQQAQGLKRGLSARHIRFMALGSAIGTGLFYGSASAIQMAGPAVLLAYLIGGAAVFMVMRALGEMAVHNPVAGSFGHYATTYLGPMAGFILGWTYAFEMVIVAIADVTAFGIYMGFWFPEVARWIWVLGIVFLIGGLNLCNVKVFGEMEFWLSLLKVGAIVAMILAGLGIMAFGFSQVGTGHAVGMSNLFDHGGFMPNGVGGLIASFAVVMFAFGGIEIIGVTAGEAKDPQRVIPKAINAVPLRILLFYVLTLFVLMCLYPWPQIGSQGSPFVQIFSNLGIGSAAAVLNVVVISAAISAINSDIFGAGRMMYGLAQQGHAPRGFSKLSKHGVPWMTVVVMGAALLIGVLLNYLIPENVFLLIASIATFATVWVWLMILLTQVAMRRSMSREQVAQLKFPVPFWPYGPAMAIAFMVFIFGVLGYFPDTQAALIVGVIWVVFLVASYLLWCKPRAGQGQPVAEPAELHR

SEQ ID NO: 20348 - protein, 370 aa, Zea mays
  unsure (1)..(370): unsure at all Xaa locations
MAMMVDPPNGMASQGKHYYTMWQTLFEIDTKYVPIKPIGRGAYGIVCSSVNRETNEKVAIKKINNVFDNRVDALRTLRELKLLRHLRHENVIALKDIMMPAHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMGEADLAFIDNPKARKYIKSLPYAPGAPFTGMYPQAHPLAIDLLQKMLVFDPSKRISXVTEALEHPYMSPLYDPSANPPAQVPIDLDIDENLGVDMIREMMWQEMIHYHPEVLTRISM

SEQ ID NO: 20349 - protein, 336 aa, Rhodospirillum rubrum
MAATRRKPRNGSSPATPTPDDIKGFYRDMLLIRRFEEKAGQLYGMGLIGGFCHLYIGQEAVVVGLQCQAHPGDSIITSYRDHGHMLAAGMDPKGVMAELTGRRGGYSKGKGGSMHMFSKENGFYGGHGIVGAQVPLGTGLAFAHKYRGDGGVCFCYLGDGAANQGQVYESFNMAALWKLPVIYVIENNKYGMGTSVERASATKDLATRGAAYGIPGISVNGMDVLAVKAESEEAVDRVRAGEGPLILEMKTYRYRGHSMSDPAKYRTKEEVSKMRAESDPIDHLRQTIVSDAILDEEALKEIDKEIKSVVSQAAEFAQNSPEPDAAELYTDVLVEA

SEQ ID NO: 20350 - protein, 207 aa, Brassica oleracea
MAMLGGVRDLPANENSVEVESLARFAVDEHNKKENALLEFARVVKAKEQVVAGTMHHLTLEIIEAGKKKLYEAKVWVKPWLNFKELQEFKPASDDGAPSTTITPSDLGCKKVSDENASGWREVPGDDPEVQHVADHAVKTIQQRSNSLFPYELQEVVHANAEVTGEAAKYNMVLKLKRGEKEEKFKVEVHKNHEGVLHLNHMEQHHD

SEQ ID NO: 20351 - protein, 257 aa, Neisseria meningitidis MC58
MYRQIGMWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 20352 - protein, 203 aa, Zea mays
MEDEEHEVFGQEIPVDGEDVDMAAGDDATKLQELDDMKRRLKEMEEEAAALREMQAKVAKEMQGVDPNATTSENKEEMDSRSVFIGNVDYACTPEEVQQHFNSCGTVNRVTILTDKFGQPKGFAYVEFVEVEAVQEAIKLNESELHGRQLKVAPKRTNVPGMKQPRGRGFNPYHGHPYMRPYGYSPYGYGRFPRFRRPRRPYF

SEQ ID NO: 20353 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFINLNRSNVVL

SEQ ID NO: 20354 - protein, 293 aa, Bacillus cereus ATCC 14579
MKKVRKAIIPAAGLGTRFLPVTKAMPKEMLPIVDKPTIQYIVEEAIESGIEDIIIVTGKGKRAIEDHFDHSFELEQSLLEKGKHEMLEKVQASSKINIHYIRQKEPKGLGHAVWCARKFIGNEPFAVLLGDDIVQAETPCLRQLMDQYEGTQSSVIGVQTVPENETHRYGIIDPVEQNDRRYQVRQFVEKPEQGTAPSNLAIMGRYVLTPEIFMFLENQQTGAGGEIQLTDAIQRLNEVQRVFAYDFKGTRYDVGEKFGFIKTTIEMALQNEELNVELMKYMKELVKKEEVHS

SEQ ID NO: 20355 - protein, 98 aa, Buchnera aphidicola
LPSASLNDSNFGLYEPAGGSAPDIAGKNIANPIAQILSIAMLVRYTMKLPMISDHIESAVIDTLKKGYRTLDIANDKEQYVSTNDIGDIISEILKKRI

SEQ ID NO: 20356 - protein, 313 aa, Cicer arietinum
ETVAIKKVLQDKRYKNRELQTMRLLDHPNVVTLKHCFFSTTEKDELYLNLVLEYVPETVYRVIRHYSKMNQRMPLIYVKLYFYQICRALAYIHNCVGVSHRDIKPQNLLVNPHTHQLKLCDFGSAKVLVKGEPNISYICSRYYKAPELIFGATEYTTAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFLDELRDPNTRLPNGRHLPPLFNFKANELKGVSAEMLVKLIPLHARKQCALFVS

SEQ ID NO: 20357 - protein, 278 aa, Methanothermobacter thermautotrophicus str. Delta H
MMRVVSVGTCNMDFIFRVQEFVEPDSEMYIDDIHILPGGSALNFAVWISALGFSSDIVAATGGDMYGEIIRSRLESEGVSTGCLSVVEKPTGMAFISVDGSGRRSIYSYMGANAELEIGTPEGRCIRAADAVHLSGCYVEVAQRVAEIREVYFSPGRLLAGYGLDVLEPVLRKTEVLFLNDDELEILTGSRKSGISRLLGVGVDYVVVTHGPGGASFFSADHSLEMKVEDAGAIDTTGAGDAFAAGFMSEWLRGYEPLECLRGGHRAALKVISRFGAF

SEQ ID NO: 20358 - protein, 221 aa, Methanococcus vannielii
MAKARIGHFVEAQVLESIGVDMIDESEVLTPADEINHINKKAFTAPFVCGARNLGEALRRIDEGAAMIRTKGEAGTGNVVEAVKHMRAVNEGIARVVGYHEMGLEAELVQMARNELKVPMEIILEVAKLKRLPVVNFAAGGIATPADAALMMQMGCDGVFVGSGIFKSGNPEIRAKAIVEATYNFDKPELIGEVSKNLGEAMVGINIDQIPEEMLLAKRGI

SEQ ID NO: 20359 - protein, 335 aa, Novosphingobium aromaticivorans
MQAAAIRRQRTELRLTFAARDCALHQEYETTFGYRGGMTLKEQRKPIRKAVFPVAGLGTRFLPATKAIPKEMLPIIDRPLIQYAVDEAREAGIEQLIFVTGRGKTAIVEHFDTAYELEHTMRDRGKVLDILAPTRIQPGNLVTVRQQVPMGLGHAIWCARAVVGDEPFAIFLPDEMMIGTPGCMKQMVDAYEDVGGNLISVLEVPAAEVSSYGVIAPGARVSDTLTEVKGLVEKPKREDAPSNLIISGRYILQPEVMRTLECQESGAGGEVQLTDAMARMIGRQPFHAVTFAGRRYDCGSKAGFVEATLALALEREDMAEDVRAIMRRLLAQSGG

SEQ ID NO: 20360 - protein, 198 aa, Glycine max
MGKKKLEIKRIENKSNRQITFSKRRKGLMKKARELSILCDAKLALLIFSSTGKLYELCNGDSLAEVVQRYWDNLGASGTDTKGLRFEIADIWSDEAFSQLVQSHFGVSEREHLSVTDLMELEKLVHSALSRIRSAKMRLMMESVENLKKKEHILRNENELLEKQIEAQKKADDVNNVVTRFIDYDQTDRVTHNLLPGL

SEQ ID NO: 20361 - protein, 272 aa, Oryza sativa
MTKSSCAHVVGVPVTSKAYAIEEATTARDGGKKVDGDRLAVSLTHPSPYTSFGYKHSSKLQVIHWVNKLGRRAQGFRDHVTLGPKLSETVRGKLSLGARILQAGGVERVFRQAFSAEKGERLVKALQCYLYTTGGPIAGMLFVSNRKIAFRSDRSLAVTSPAGDVVARVPYKVVVPLRRIKRVRPSENADKPEQKYIHVATVDGFEFWFMGFVSYQRCCKYMQQIDVWPLQVQVLYVCNIDEPRNLVLLNEKYLNSSLDEHRQRIETLHFRP

SEQ ID NO: 20362 - protein, 512 aa, Zymomonas mobilis
MTLAVVHFWRLFRWSRILSKHGVLKTVEKSTIVPLSLRLIIRLLRIGYRVPNPPDYTGAFVALGPAAIKFGQTLATRPDLIGEETAAQLACLQDSVPPLPFKDIRIVIENALGCPIEKSFRFFNEIPIGSASIAQVYQAETLDGVTVAVKVLRPGIKLAFRKATETYEWAATKIESLNDEFIRLRPKLVVKTFRQWTIRELDLRREAASASELAENMEAVPGFKVPVIDWNRTSQSMMVMQWIDGIKLSDHQKLQEAGYDLKSLATRLVRSFLRQAIADGFFHADLHHGNLFALKDGSLAVVDFGIMGRIDKKARRWLAEILYGLITGNYSRIAEIHFEAGYVPSHHDIAEFTTALRTIGEPIRGLSVRDISISHMLDGLFSITREFEMQTQPHLLLLQKTMVVVEGVATSLYPDINLWDTAEPFVREWLRSELGPEAKIAEEFYKTLQSIKRLPELIDRIDQYYPPLTIEEQLYPVANKNSIKSAATKHYLPVFILSAFIIGIVLGHYHFF

SEQ ID NO: 20363 - protein, 347 aa, Schizosaccharomyces pombe
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 20364 - protein, 110 aa, Glycine max
  unsure (1)..(110): unsure at all Xaa locations
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 20365 - protein, 411 aa, Glycine max; identical to SEQ ID NO: 7510

SEQ ID NO: 20366 - protein, 387 aa, Zea mays
MADQANQPTVLHKLGGQFHLRSIISEGVRARNICPSVSSYERRFATRNYMTQSLWGPSMSVSGGINVPVMQTPLCANAPAEKGGKNFMIDFMMGGVSAAVSETAAAPIERVKLLIQNQDEMIKSGRLSEPYKGIVDCFKRTIKDEGFSSLWRGNTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 20367 - protein, 141 aa, Zea mays
MAGASAVAVLPVATPAAPRRGGAGPCSCLAPGGSSFYRRMNCRRDSPSAVAPTRRRVVARLSGRDPGEAGTDAGVGQILKGDDSGYLWTLVLGSLGGAAVIKYGSILLPDITRPNIVVALLMVSLPVVAAVLALLKASSAD

SEQ ID NO: 20368 - protein, 263 aa, Triticum aestivum
PKPTTTLPLSFLPFLHRVSSQTKSHPESTSPPPILFLPLPCRLRRRESPSRPSPRPRSPPSRADLFPEPPEGGDGRPVSSRAGMQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPSVKCAICDYISNITNTGINTMPPAPCPRPTSNESAYNASSASVPTPQPQNVTVVVENPMTVDEKGKLVSNVVVGITPGKN

SEQ ID NO: 20369 - protein, 698 aa, Oryza sativa
PPPNTYSESWWGGKEERGTPVVVKMDNPYSLVEIDGPGMAAPSEKARGKNAKQLTWVLLLRAHRAVGCVAWLAAGFWAVLGAVNRRVRRSRDADAEPDAEASGRGRAMLRFLRGFLLLSLAMLAFETVAHLKGWHFPRSAHLRMPEKEEIEGWLHRAYVAWLAFRIDYIAWAIQKLSGFCIALFMVQSVDRLVLCLGCFWIKLRGIKPVADTSISNDDIEATAGDGGGYFPMVLIQMPMCNEKEVYETSISHVCQIDWPRERMLVQVLDDSDDETCQMLIKAEVTKWSQRGVNIIYRHRLNRTGYKAGNLKSAMSCDYVRDYEFVAIFDADFQPNPDFLKLTVPHFKGNPELGLVQARWSFVNKDENLLTRLQNINLCFHFEVEQQVNGVYLSFFGFNGTAGVWRIKALEDSGGWMERTTVEDMDIAVRAHLNGWKFIFLNDVKVLCELPESYQAYRKQQHRWHSGPMQLFRLCLPAVFKSKISTWKKANLVMLFFLLRKLILPFYSFTLFCVILPLTMFVPEAELPIWVICYVPVIMSVLNILPAPKSFPFVIPYLLFENTMSVTKFNAMVSGLFQLGSSYEWVVTKKAGRTSSESDILALAEAADADARPPPAKLHRGVSEGGLKEWAKLHKEQEDATAAKAPNRIFKKELALAFLLLTAATRSLLSAQGLHFYFLLFQGVTFLAVGLDLIGEQVS

SEQ ID NO: 20370 - protein, 384 aa, Nicotiana tabacum
MCVQESEEVSEEMENLDISKSDENIKIGSLQVEDELGNTQKENCEKNTSSSFSVIRNSFPMESISEDTTIADRKQILSNKFLPTLRSGEWSDIGGRLDMEDTHICIADLAKNFGQSILGEEEAVSFYGVFDGHGGKGAALFVRDFLPRIIVEDADFPLKLEKVVSKSFLETDAAFAKSCSADSDLSSGTTALTAMIFGRSLLVANAGDCRAVLSRGGLAIEMSKDHRPCCVSERTRVESLGGFVDDGYLNGQLGVTRALGDWHIKGLKEVEKGGPLSAEPELKLLTLTKEDEFLIIGSDGIWDVFRSQNAVDFARRRLQEHNNAKLCCKEVVDEAKKRGAIDNLTVVMVCFHSEPPPTIVFQRSRIRKCISAEGLQNLRSLLDG

SEQ ID NO: 20371 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 20372 - protein, 460 aa, Porphyra torta
WDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESDTDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 20373 - protein, 701 aa, Eremothecium gossypii
MATVGASAEQLLQDINCEGYLGAFRKYEISSVDQLQHLDHEILEQVGIRSIGDRIRILNKSRTLQAGRDKGLLEELQQVIGKINALSAGPMAISEELVTDRHSVIFILNDGSAKKVNVNGCFNADSIKKKLIKRLPPEFVAVAQNGEETSSQDYDVFVVDYAKNVLHLLYDVELVTICHSSDRVEKNRLIFVSKDQTPSDKAILTSKKLYLKTMSAIHQLGSLPTMLQTQGATTVGNYATPGAEAPAGDEDSLRIDNSKESLRRIFNQRPPSELISTNLPEYFPHTDFKRLQKTLRSSFRQSVRMSMLRPGAPLPEGNNVGNILVNQNQAVDRALLQSLDGTKTSSRSSGRSSVDGDASSMGSERRTNASKSTTLDGRDSDAGGRIELLNSESESECDDDNIVSLPTKVVTPKSWLKGARIGSGSFGSVYLGMNAHTGELMAVKQVELEPTTVMASSDDKKSHPSSNAVVKKLTDPPQDGGRASSTKMNLLKELHHENIVTYYGSSQEGGNLNIFLEYVPGGSVSSMLNSYGPFEEPLVKNFTRQTLVGLTYLHRKNIIHRDIKGANLLIDIKGSVKITDFGISKKLSPLNKKQNKRASLQGSVYWMAPEVVKQVVTTEKADIWSVGCVVVEMFTGKHPFPDFSQMQAIFKIGTNTIPELPSWASDGAKAFLYQTFELDYKKRPSSVELLQHKWLDTTTML

SEQ ID NO: 20374 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 20375 - protein, 500 aa, Saccharomyces cerevisiae
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 20376 - protein, 353 aa, Nostoc punctiforme
MQLKLSASRLPFAPLLLIAPFFLWGTAMVAMKGVIPHTTPLFMAGVRLIPAGMLILIAAAFMGKPQPKGWAAWLWIALFALIDGTLFQGFLAEGLVRTTAGLGSVMIDSQPLAVALLSLWLFQEHIGFWGWLGLGLGVTGISLIGLPDEWILHILDSGANITIGNWQDLFASGEWLMLLAALSMAVGTVLIRFVCRYADPVTATGWHMILGGLPLWGISSVLESQQWENLGGSDLVALSYATVFGSAIAYGLFFYFASSGSLTSLSSLTFLTPVFALLFGNLFLSEVLSPVQWVGVFLTLISIYLINQRDALGAQNDTITVGEIANIQPPVLDSSAKKLNPVSLAVRESEPEI

SEQ ID NO: 20377 - protein, 226 aa, Oryza sativa
  unsure (1)..(226): unsure at all Xaa locations
LERPRASHSLNLVAGWLVLFGGGCEGGRHLDDTWVAYVGNGAGNRSSAVFSWQQLDSGTPSGRFGHSCSIVGDALVLFGGINDQGQRLNDTWIGQIICEESRRMKISWRLLEVGPHAPYPRGAHAACCVDDKSIVIHGGIGQSGSRLGDTWLLDLSNGLRSGIWHQIEDXEPLPLSRSGHTLTWIGGSRMVLFGGRGPEFDVPNXVWLLDINERVPKWKELKYDLV

SEQ ID NO: 20378 - protein, 842 aa, Thermosynechococcus elongatus BP-1
MTSLIPPGCPTVLTEDDRTGTSIETLRRAFMDNLFFIQGRFPEVATKNDYYLALAYTVRDRLLLRWLNSAKTYRDQESRTVCYLSAEFLLGPHLGNNLINLGLYEAVEEAMRQTGLNLKELLDQEEEPGLGNGGLGRLAACYMDSLATLEIPAIGYGIRYEYGIFDQEIRDGWQVEITDKWLRYGNPWEIPRPELILPVKFGGHTYSYTDDQGRYRVIWEPHQVVQGVAYDTPILGYKVNTANLLRLWRAEAVESFDFQAFNTGDYYGAVNQKIASENITKVLYPNDEQLQGKELRLMQEYFFCSCALQDMIRLYKQSGKQDLSRFHEKFTVQLNDTHPAISVAELMRLLVDEHLMPWEQAWDITRQTFAYTNHTLLPEALEKWPLDLFGSLLPRHLQIIYEINRRFLDEVRLQYPGDNDRLRRLSIIDESGCRYVRMAHLAAVGSHAINGVAVLHSELLKQTVLRDFYELTPEKFSNKTNGVTPRRWMVLSNPGLTRLITERIGEDWVKHLDQLRQLEPLAADAEFAAQWRSVKHGNKERLAQYIRDRIGVTVDPHSLFSILVKRIHEYKRQHLCVLKVITLYQMLRDQPHLEMVPQTFIFGGKAAPGYYMAKLIIKFINSVADVINRDPVVRDRLRVVFLPNYNVTLGQRVYPAADLSQQISTAGYEASGTGNMKFALNGALTIGTLDGANVEIREAVGAENFFLFGHTVEQLQELRCNGYRPWEFANGHPMLKRVLDLISSGYFSHGDTELFRPLVEHLWQDDRYCLLADYQSYVDCYQRVLQVYQDQAQWAKMSILNVARMGKFSSDRAIREYCQDIWHVQPVKIVLPATAYMTSPGQ

SEQ ID NO: 20379 - protein, 155 aa, Xylella fastidiosa Temecula1
MNVTFDLTPPSPSQREALIATLNAEERRILLQHGTEAPFCNRLLDNNQLGTYTCRLCGLPLFHSNAKFKSGTGWPSFFEPYTHTHIRKQHDTSHGMIRTEILCARCNSHLGHLFPDGPPPTYERYCLNSVSLTFIPTGTLLPDQLHRGDNTTYRT

SEQ ID NO: 20380 - protein, 355 aa, Arabidopsis lyrata subsp. petraea
ISYLTYDRADMAFAHYGPFWRQMRKVCVMKVFSRKRAESWASVRDEVDQMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGSGRRSCPGMQLGLYA

SEQ ID NO: 20381 - protein, 578 aa, GIBBERELLA ZEAE PH-1
MATLHQYDYIFALTVIFACLDAWNIGANDVANSFGTSVSSRSLTMKQAMLVAAVCEFSGSVSVGSRVADTIRTKIVDPHHYDSSPGVLLLVMMCTIMSSSLFLTFATRQGLPVSTTHSLIGGLVGAATASIGIQKVSWGWHGVSQIFAAWIIAPLIAGCFGYVLFLCTKKFILTQRTAVKRAFFSIPVYTYLTVGALTMLLVWKGIHVINLSTRDTVIAIFVTATGMTFLQAIFILPFLWTRIMHEDWTLKWYHVFQGPMLLWRSPPPPTPIGFTKPSIRDYYQGHLTREELNYIRTSETLLQSIQTPNGELPDLDRDDEWILPPPAQTPPKTPPNRFERRSSSELVPPCPEGDWNSPRVLAWKVNRVLLRGLEKDVVAMQKRNNILNWDLEDMHARSAHYDNRAEYMYSALQILTAATASFVHGANDVSNAVAPFTTAYQVWSSGGIPEYIEIPIWILAVGGACIVVGLLTYGYHVMRTLGNRLTLISPSRGFCMELASAVTVLMATRLSLPVSTTQCITGATVGVGLANGDWRCINPKLVAWIYLGWMVTLPVTGVISGCLMGLIINAPRWEVQSV

SEQ ID NO: 20382 - protein, 409 aa, Methanothermobacter thermautotrophicus str. Delta H
MMGVEFLEIIDLDDARRITGELFSELYSQGTESVDILDADGRVLADDIESPVDLPPFDRASRDGYAVRAADTFGADEENPATLRCIETVEAGSVPSLEVAEGLCTRISTGAPVPEGADAVVMVEYTWEEVDRVYIQRPAYPSQHIAARGSDIRAGNVLLRTGTVLSPDKIAALSAAGITRVNVISKPSVCVISTGNELIEPSGQLEPGKIFDSNSAGLSSALKEAGCSVKHGGIVRDDYGELRDAILRGLEEADMVITSGGTSAGAGDILSEVLDELGRVVIHGISIKPGKPTIVGVVDDKIVVGLPGFPVSALIVFMSLIEPFIRKLSGRKASSGHVKTLKLAERLHSSRGRVHYALVMVDGDYARPIFKDSGAVAALAGADGYIEVPKNVEIINEGEEVEVVLFENR

SEQ ID NO: 20383 - protein, 361 aa, Medicago sativa
FGILGGGIVALIVASIFDHKYKVPTFEENPAASLLVPQFDYVWRLILMFGALPAALTYYWRMKMPETARYTALVAKNAKQAAADMSKVLQVELEVEEEKVQKMTSDKRNSYGLFTKQFAKRHGWALFGTCSTWFLLDIAFYSQNLFQKDIFSAIGWIPPAKEMNAIHEVYKIARAQTLIALCSTVPGYWFTVAFIDHMGRFAIQMMGFFFMTVFMLALAIPYDHWSKEENRIGFVVMYSLTFFFANFGPNATTFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGSRV

SEQ ID NO: 20384 - protein, 220 aa, Oryza sativa
  unsure (1)..(220): unsure at all Xaa locations
EDLYYPHPFVQDVLWATLHKFVEPAMLRWPGNKLREKALDTVMQHIHYEDENTRYICIGPVNKVLNMLACWIEDPNSEAFKLHIPRVHDYLWIAEDGMKMQGYNGSQLWDTAFTVQAIVATGLIEEFGPTLKLAHGYIKKTQVIDDCPGDLSQWYRHISKGAWPFSTADHXWPISXCTAEGLKAALLLSKISPDIVGEAVEVNRLYDSVNCLMSYMQFNG

SEQ ID NO: 20385 - protein, 293 aa, Rhodobacter sphaeroides
MDLRSIGMGLAFAFMWSSAFASARIIVAQAPPLSALSLRFLCSGLIALALGAALGQSARLSPAQWRGVVIFGLCQNALYLGLNFVAMRWVSASFAAIVASTMPLLVALAGWIFLHERLRPVTALGLLAGMAGVALIMGTRLSGGEDALGFLLCVAGVIALTAATLTVRVASSGGNLLMIVGLQMLVGSAALAPAALLTETPLEVQWSGSLVAAFAYTTLVPGLLATWVWFLLVGRIGAVRGATFHFLNPFFGVAVAAVLLGERMGIWDVAGVVVIAAGILAVQLSRVPEAARR

SEQ ID NO: 20386 - protein, 333 aa, Desulfovibrio desulfuricans G20
MAVTLGINGFGRIGRYLVRLLANDPELNTAVVNARADNESLARLFKYDSCHGTYPAEVKANSDGFTVNGKQIVVTRYGHNEWKWADYGVDIAVESTGTVKDRAGLALHMERGAKKTVISAPCADADLTVVMGVNDHLYDPAQHDVISNASCTTNCLAPVVKVLNDTFGVRHGLMTTVHSYTMSQRLLDGTHKDPRRGRAAAMSMIPTSTGAAKAVGLVIPELAGKLNGMAIRVPTPNVSLVDLTCELGKSATAEEINAALREAAATTLKGNMGYTEEPLVSCDYMGSTFGGVVDGPCTSVMEGNMAKLIIWYDNEAGFTNQLVRLLRKVGNSL

SEQ ID NO: 20387 - protein, 197 aa, Yersinia pseudotuberculosis
SSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHA

SEQ ID NO: 20388 - protein, 393 aa, Triticum aestivum
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 20389 - protein, 404 aa, Chlorobium tepidum TLS
MFDEIEFDRIKRLPKYVFAAVNELKMAERRAGRDVIDFSMGNPDGPTPQHIVDKLVESVSKPKTHGYSVSKGIYKLRGAIGGWYRDKYNVDLDLDREVVVTMGSKEGYVHLVQAITNPGDLAIVPDPCYPIHSQAFILAGGNVHRMKLEMNEDYTLDEEAFFHNVETALRESSPKPKYLVVNFPNNPTTATVELPFYERLVELARRERFYIISDIAYAEITFDGYVTPSILQVSGAKDVAVESYTLSKTYNMAGWRMGFMVGNAKLVGALEKIKSWLDYGTFTPIQVAATIALTGDQSCVREIREVYRKRRDVLISSFANAGWDIVSPKASMFVWARIPEQMRAMGSLEFSKKLLIEGKVAVSPGIGFGTYGDEYVRVAMIENEERIRQAARNIKRFLKNNAGS

SEQ ID NO: 20390 - protein, 488 aa, Isthmoplea sphaerophora
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHAIGSCIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 20391 - protein, 394 aa, ASPERGILLUS NIDULANS FGSC A4
MSQNRSGVFSNLRMGEVVREKVQDGLTGETKEIQYSQCKIVGNGSFGVVFQTKMMPSGEDAAIKRVLQDKRFKNRELQIMRIVRHPNIVELKAFYYSNGERKDEVYLNLVLEYVPETVYRASRYFNKLKTTMPMLEVKLYIYQLFRSLAYIHSQGICHRDIKPQNLLLDPATGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKAPHEAIDLISALLEYTPTQRLSAIEAMCHPFFDELRDPNTKLPDSRHPNGAARDLPNLFDFSRHELSIAPSMNSRLVPPHSRPALEARGLYIDDFKPLKKEEMMAHLD

SEQ ID NO: 20392 - protein, 618 aa, Haemophilus influenzae Rd
MSQLANPELMKVVILLASSVTIVPLFKRLGLGSVLGYLVAGCLIGPSVFGIVQEPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDTIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 20393 - protein, 124 aa, Triticum aestivum
MEGLPAQVEVPSYFLCPISMEIMRDPVTLSSGITYDRESIERWVFTDGHGECPMTKQKLGAADREPTPNHTLRRLIQGWCAVHAVERFPTPRAPIDAARVETIVDAARRGQDLLVASLRELADI

SEQ ID NO: 20394 - protein, 303 aa, Zea mays
  unsure (1)..(303): unsure at all Xaa locations
MSFHYHDHGLSMDAAAAAAAAASSPNPSGFSPGIGGEREKAAIAAHPLYERLLEAHVACLRVATPVDQLPRIDAQIAARPPPLAAAXXXAXAGAAAAGGPSGGEELDLFMTHYVLLLCSFKEQLQQHVRVHAMEAVMGCWELEQSLQSLTGASPGEGTGGTMSDDEDNQVDSEANMFDGNDGSDGMGFGPLILTEGERSLVERVRQELKNELKQGYKEKLVDIREEIMRKRRAGKLPGDTASVLKAWWQAHSKWPYPTEDDKARLVQETGLQLKQINNWFINQRKRNWHSNPTSSAEKTKKKR

SEQ ID NO: 20395 - protein, 855 aa, Sorghum bicolor
MAFSPRSPWSRPKRNDVYSTFVVHGDDDEDDARGSRRGRGPSTRAEEDEEEDPSSLPPLLQRLPKDFGGPSFDEDEDAYSSDPDDASLSATVVFKSGAPASARSPFLDLRRSSPRATDDDPYSTFVVHSTARSGGTSSSPRGSASGTFIRRSGGSSSPHESVSGTFIRRTSTPSSPRDSVSGTFIRRPGSPSSPRGSFSGTFIRHTSGGSSSYESASGGGGGFGSSFWSPAVEQTEELRQPSPLMQQQQQQHSRRKPSVSSAPDSVTREDPSTKYELLHELGKGSYGAVYKARDLRTQELVAVKIISLTEGEEGYEDIRGEIEMLQQCSHPNVVRYFGSYQGEDYLWIVMEYCGGGSVADLIGITEEPLDESQIAYICREALKGLAYLHSIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDPRLRPAASEMVKHKFIEKCNSGASKMLAKIKEAKKIRATLAVQNELSDPDNTMQDVPVRINEDYGETVPTNSQQHMNHGTYNDCQAGDFGTMIVHTEDGDEVAESPIFPRTEFIPGLGSINSFTHDPKRAELISSFWAENTGDSDANKDRDLDDRPDIQESKAIPPLTGTVKKHIGAEGTIRRHDNQVNLSPGFANTTKLNSSPSRKAFSVQDKLWSIYAAGNTVPIPFLKAIDISPLALVSENEAGNGLAGSSTNDALEAVRELFSGDGQAKKGRKGQNEVPLPPGVHHRLMTSPTLMNLAQALAYHKTCYEDMPLQDSQATQEQQTIQNLCDTLRTILRL

SEQ ID NO: 20396 - protein, 389 aa, Oryza sativa
MEAAAAAAAEEEAGNPDGVEGAAVAAVAPEAAAEGPSEPNAGEASREPDAGQASREPGAAGPSREPDVAGPSREPDAAGPSREPGAAGGSREPGAAGGSRQPVPDAAQLAVVPYVEDIDRYLRSLEAEQTRRPMINYVQEIQGGIINMDVRGILVDWMADVAYVFNLQEETLHHAVSYVDRFLSKIAFPGDKLKLLGTTALFVASKYEEIHPPHVRNFSAVTVNTYTTQQVSKMELDILRFLNFDVGSPTVITFLRKFLTSCCGGNNSSNRKLELMCNYLAELSLLDDYYIRFLPSIVAAACLFVGKFTLNPNTRPWFGSVSTITPPENIKGGVEKYMVSRIYMCVFDLPMLFLMETWSSSGVSNHTKLQLKQNMMELPIENPTFISAS

SEQ ID NO: 20397 - protein, 460 aa, Arabidopsis thaliana
MVRSDENSLGLIGSMSLQGTLNRSILLLKIKTFVLFDFSPKLILNLLDVGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 20398 - protein, 440 aa, Glycine max
MEAERKRLKPRLERRNAMKNIDYQLKDEDADADADAAYLNQRSFRVKGIDGEFDRILRSLGLSGPEDFAIPAAAWEEARAHKARSSVQPREGGIKGVRPPVLEPPLVTSAWTSQQQTERVPPSDSVSRDDDVAVEAQTEEVSGFADDHGSFDIHNLSPNGSGYFRSWQKGDILGKGSFGTVYEGFTDDGNFFAVKEVSLLDDGSQGKQSLFQLQQEISLLSQFRHDNIVRYLGTDKDDDKLYIFLELVTKGSLASLYQKYRLRDSQVSAYTRQILSGLKYLHDRNVVHRDIKCANILVDANGSVKLADFGLAKATKLNDVKSSKGSPYWMAPEVVNLRNRGYGLAADIWSLGCTVLEMLTRQPPYSHLEGMQALFRIGRGQPPPVPESLSTDARDFILKCLQVNPNKRPTAARLLDHPFVKRPLLSPISPVSPSINLLMS

SEQ ID NO: 20399 - protein, 282 aa, Magnetospirillum magnetotacticum
MFPVGGMGTRFLPATKAMPKEMLPVVDKPLIQYAVEEAAAAGCEHFIFVTGRGKNALEDHFDHNPELERILKDRGKFDLVEAVTSWMPKSGQISYTRQSEPLGLGHAVWCARDLVADEPFAVLLPDDLILSKTACLKQMAAVHTEVGGHVVAVSDVPREHTKRYGILDVEHDNGRLARAKGLVEKPDPEVAPSTLSIIGRYILHPAVFDVLDKKEKGAGGEIQLTDAISQTIGMVPFHGLRFEGARFDCGDKVGWLEANLAFALARDDMAEAARDLITRFHG

SEQ ID NO: 20400 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 20401 - protein, 411 aa, Escherichia coli O157:H7
MEFTTGLMSLDTALNEMLSRVTPLTAQETLPLVQCFGRILASDVVSPLDVPGFDNSAMDGYAVRLADITSGQPLPVAGKSFAGQPYHGEWPAGTCIRIMTGAPVPEGCEAVVMQEQTEQTDNGVRFTAEVRSGQNIRRRGEDISAGAVVFPAGTRLTTAELPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLHRNADGELEVTTTGHQGSHIFSSFSLGNCFIVLERDRGNVEVGEWVEVEPFNALFGGL

SEQ ID NO: 20402 - protein, 467 aa, ASPERGILLUS NIDULANS FGSC A4
MAQDKLKNIPETQVSRPSSPSNPPSSTQGVHSRRIPIFFRSTLFQILTVGLCAFCAPGIWSAMNGLGVGGSQSPNLVNAANALLYAFMTVTCFLGPFLTNLVGFRYTLSLGSIGYPLYAAGLYLNNRTGATWLVYLGSVTCGISAGFFWSVEGAIATGYPEDRKRGRYIATWFTFRNFGNIIGGAISLGINVNLNQQGQVGYQTYLGFIAIQCLGCLIGLLLSNPEKVVRDDGTEIAASTDTIHWKTEAKAMWKRGKSKPILLLTPLFWYFGWVQAYPGTYLATYFTIRSRALGSFLSAIVGTIATWLGGSLVDIPWTLNRKHRALATWTLIAALNSTTWIWAVIIQNEYRHTNPVLDWDDQRTFGRGFGIYLFERLSVGIVENYIYWCIGNLSDSPGEQIRYSSLLRGIETAGVAVGFGVQAVPTTLIVTAGINFGLWFFALPISFWATLMVVRKFEEAAWNSAVR

SEQ ID NO: 20403 - protein, 637 aa, Oryza sativa
MALASSSRLLHRFSSSSLPRPCRRRVPRPRGHSRFAVRWEHRAAAVVLLLPRALLGGGFQDADAAESDDEEEEDAHGVLRPLDADDVNLDLHAPPSGPERWDVLGLGQAMVDFSGMVDDEFLHRLGIQKGTRKVVNHEERGRVLRAMDGCSYKAAAGGSLSNSLVALSRLGSSRSTNYPELRIAMAGSVGSDPLGSFYRAKLRRANLHFLSKPVKDGTTGTVIVLTTPDAQRTMLAYQGTSSTLSYDSDLASLVSKSNVVIVEGYLFELPHTIEAIKQACEDAHKNGSLIAVTASDVSCIKRCYNDFWDIVTNYADILFANANEARAFCELSSTDSPMSAARYLSHSVPLVSVTDDTCGAGDAYASGILYGILRGSSDLKSIGLLASRVAAIVVAQQDSGGCLAFSDELHRRVAAPCQDRMVVATEEMAVYCFDALVSHYSGDQPPPPAFEEGIHPLFVTWKKATNGSEPRLRGCIGTLEARQIVTGFKEYALTSALRDRRFPPIQSKELPYLECTVSILTEYETALNHLDWEVGKHGLIIEFTDPDYNMRRSATYLPEVAAHEGWTHLETIDSLMRKAGYNGTITDSLRKKLRVTRYQSTLYTMHYGEYAAYVKKNRGAAPEINGAPIINGFKPGH

SEQ ID NO: 20404 - protein, 248 aa, Saccharomyces cerevisiae
  unsure (1)..(248): unsure at all Xaa locations
MARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 20405 - protein, 357 aa, Blumeria graminis
MAEFVRAQIFGTTFEITSRYSDLQPVGMGAFGLVCSAKDNLTGQNVAVKKIMKPFSTPVLSKRTYRELKLLKHLRHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIHTIASENTLRFVQSLPKRVRQPLKDKFTNADPLAIGLLEEMLVFDPRRRIKATDALAHEYLAPYHDPTDEPIALEKFDWSFNDADLPVDTWKIMMYSEILDYHNVDSENQAMEDPLECP

SEQ ID NO: 20406 - protein, 111 aa, Buchnera aphidicola
VSDECAIITGSIGMLPSASLNEKKFGLYEPAGGSAPDIEGKNIANPIAQILSVSMLVRYGMNLKKIADKIDQSVISVLKKGYRTADISNNNNYLKTNEMGDVIANTLISGE

SEQ ID NO: 20407 - protein, 488 aa, Chordaria flagelliformis
MPEDVQNRTRIKSERYESGVIPYAKMGYWDADYNVKETDILALFRITPQPSVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQNMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAGTTCGPLKAALDLWEDITFDYTSTDTPDFVEVATESR

SEQ ID NO: 20408 - protein, 461 aa, Xanthomonas campestris pv. campestris str. ATCC 33913
MPLPTDPVAETASSAAPALRHALKPRQLMMMGLGTAIGAGLFLGSGVGIHAAGPAVLVSYLIAGALVIIVMNALGEMAAAKPASGAFSVYAADAMGPTAGATVGWLWWLQIVVVIAAEAVGAASLLATVWPALPVPMLASVFMATFTVINLLGVRNFGEFEFWFAILKVVAILIFLMIGGALLAGLLPGVASPGLSNFTQHGGFAPKGLAGIGTALLVVVFAFGGTEIVAVAAAETADPGRSLARTIRTVAWRILVFYIGSISVIVAVVPWTSDALSSPFAAVLEVARIPGAATGITLVAVVALLSALNANLYGASRMIFSLAQRGEAPRWLGNTSRQQVPLVAVIASVLFGFAAAVLELLYPGKVLPMLLNIVGATCLLVWTISLLSQLILRARADRAGIALPFRMRGYPVLTLLALAILAVIFVLLALSADTRAQFLSMVGLTAGIALVSELARRMRKR

SEQ ID NO: 20409 - protein, 349 aa, Magnetospirillum magnetotacticum
MRQLLDHAAENGYGIPAFNVNNMEQVKAIMEAASACDAPVILQASAGARKYAGEAFLRHLILAAIETYPQIPVCMHQDHGTSPAINVRAIQSGFSSVMMDGSLKEDGKTPSDWDYNVAVTKQVVDIAHACGVSVEGELGCLGSLETGTAGKEDGVGAEGKLDHSQLLTDPDEAAEFVKATKVDALAIAIGTSHGAYKFTRPPTGEVLAIKRIKEIHARIPNTHLVMHGSSSVPQDLLKIVNDYGGALGQTYGVPVEEIVEGIKHGVRKVNIDTDLRLAVTGCIRKYFHDNPKKFDPRDYLKPSIAAMVEVCKSRYDAFGTAGQASKIKVIGLEDMSALYAKGALAPKVN

SEQ ID NO: 20410 - protein, 450 aa, Staphylococcus xylosus
GPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNMKDPQANWDFWTLLPEALHQITILMTDRGIPKGFRNMHGFGSHTYSMYNDKGERFWVKFHHRTQQGIENYSAEKAEQVMAKDRDSSQRDLFNNIEQGNFPKWKMYIQVMTEEQARNHKNNPFDLTKVWYKDEYPLIEVGEFELNRNPENYFQDVEQAAFATTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQG

SEQ ID NO: 20411 - protein, 247 aa, Triticum aestivum
  unsure (1)..(247): unsure at all Xaa locations
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 20412 - protein, 337 aa, Lyophyllum shimeji
MVNVGINGFGRIGRIVFRNALLNPKIQVVAINDPFINLEYMVYMFKYDSVHGRFKGTVEAKDGKLWIQGKPVIVYGEKNPSDIKWGAAGRDYVVESTGVFTTVEKAEGHLKGGAKKVIISAPSADAPMFVMGCNLDQYDPKYTVISNASCTTNCLAPLTKVIHDKYGIIEGLMSTIHATTATQKTVDGPSNKDWRGGRAVVNNIIPSSTGAAKAVGKVIPSLNGKLTGLSFRVPTIDVSVIDLVVRLEKPASYEDIKKTVKEASEGAYKGIIEYTEEQVVSADFIGHHASSIFDAQAGIQLNPNFVKLIVWYDNEWGYSARVCDLLVFAAEQDAKQQ

SEQ ID NO: 20413 - protein, 123 aa, Zea mays
  unsure (1)..(123): unsure at all Xaa locations
LFHCLHAVCSHHQKLGFPAKFKDFKIQNIVRSCDVIFRTLFGXCDVKSPIRLEGLAYSHGAFSSYETELFSGLIYRMKRQKIMLLIFVSGKIVLTRAKVRDETYTAFENIYPVLTKFRKVRQC

SEQ ID NO: 20414 - protein, 459 aa, Isochrysis galbana
DPEYAIKDTDLLALFRCTPQPGVDPVEAAAALAGESSTATWTVVWTDLLTACDLYRAKAYRVDPVPGASDTYFCYIAYDLDLFEEGSLANLTASIIGNIFGFKAVKALRLEDMRMPVALLKTYQGPATGLVVERERLDKFGRPLLGATVKPKLGLSGKNYGRVVFEGLKGGLDFLKDDENINSQPFMRYRERFLYSMEGVNNAAATTGEVKGHYLNTTAATMEDMYERADFAKELGSVIVMIDLVIGYTAIQTMGRWARKSDVILHLHRAGNSTYSRQKSHGMNFRVICKWMRMSGCDHIHAGTVVGKLEGDPLMIKGFYNTLLDTKTDINLPQGLFFAQDWASLRKCVPVASGGIHCGQMHQLIDYLGDDVVLQFGGGTIGHPDGIQAGATANRVALESMVVARNEGRDYVAEGPQILRDAARSCGPLQTALDLWKDITFNYASTDTADFVETPTANR

SEQ ID NO: 20415 - protein, 320 aa, Pseudomonas sp. Ki-1w
  unsure (1)..(320): unsure at all Xaa locations
CIGCHTCSITCKNVWTSREGMEYAWFNNVESKPGIGYPKEWENQDKWKGGWIRNANGTINPRIGGKFRVLANIFANPDLPSLDDYYEPFDFDYQHLHTAPLGKHQPTAGPRSLISGKRMEKIEWGPNWEEILGTEFAKRRKDKNFDKIQADIYGEYENTFMMYLPRLCEHCLNPACAASCPSGAIYKREEDGIVLIDQEKCRGWRMCISGCPYKKIYFNWKSGKSEKCIFCYPGIEAGMPPVCAETCVGRIRYLGVLLYDADRISEVASTANEQDLYEKQLEIFLDPNDPAVIRQALAXGVPQSVIDSAQRSPVYKMAVD

SEQ ID NO: 20416 - protein, 211 aa, Prochlorococcus marinus str. MIT 9313
MSELQRLKGQLPPEMQSWVFVEAAAAVDPPLITLEEIGRDEVEIQIDLEQWDNFALDHRNLLFWHEVGRVQNDTIPRDGWEMAALAIGLGGAIGELWVQDGLLLLMALGLSGFAGYRLYLKNNSEKRLQDAIAADERAIDLACRFNYSVPNAYKSLGGALKELVEQTRKKKKRSFYEDRLEALRKSAEKARAEMAEQEGSRQSVSSENVYG

SEQ ID NO: 20417 - protein, 479 aa, Staphylococcus epidermidis ATCC 12228
MEVFNMTNQLFINNEFIESQSKETMDVINPATGEAFDTITLATEEEVNDAIEKSQQAQLEWERVPQPTRAEHVKLLIPLLEKNRDEIAQLYVKEQGKTLTQAYGEIDKSISFIDYMTSLSMSDKGRVLQNSIANETIQIINKPIGVTAGIVPWNAPILVLMRKVIPAIVTGCSVVIKPSEETTLLTLRLAELFRASTIPAGLIQIVPGTGETVGTQLASHKDIQLISLTGSMRAGKSVYENAAQTVKKVNLELGGNAPVIVTSNADLDKAVNYIVTARINNAGQVCTCPERIFVHEDVHDDFLNKVTSKMKSLTVGDPFDENTDYGAIINQKQLDSIHEKVQDAIKNGATLMTGGHQLKRHGFFYAPTVLDNVRKDDNVFKDEIFGPVLAITTYRDFEQVIEDANDTNAGLSSYIFSENLTEVMTATERLKFGEVYANCEAEEVVNGYHAGWRESGLGGADGIHGFEEYYNTTVSYIRY

SEQ ID NO: 20418 - protein, 142 aa, Triticum aestivum
  unsure (1)..(142): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWDKCWKXLPMFGCNERHNKLIKQGGGRSKE

SEQ ID NO: 20419 - protein, 467 aa, Heringia mirabilis
  unsure (1)..(467): unsure at all Xaa locations
PYAKMGYWDPAYVIKETDVLALFRVTPQPGVDPIEASAAVAGESSTATWTVVWTDLLTACDLYRAKAYKVDAVPNSSDQYFAFIAYDIDLFEEGSIANLTASIIGNVFGFKAVKALRLEDMRIPVAYLKTFQGPATGVIVERERMDKFGRPFLGATVKPKLGLSGKNYGRVVYEGXKGGLDFLKDDENIISQPFMRWKERYLYAMEGVNRSIAATGEIKGHYLNVTCATMEQMYERAEFAKQLGSIIIMVDLVIGYTAIQTMGIWARHNDMILHLHRAGNSTYSRQKIHGMNFRVICKWMRMAGVDHIHAGTVVGKLEGDPLMIRGFYNTLLLPYLAVNLPQGIFFEQDWASLRKVTPVASGGIHCGQMHQLLDYLGVDVVLQFGGGTIGHPDGIQAGATANRVALESIVIARNEGRDYVPEGPQILQDAAKTCGPLQTALDLWKDITFNYTSTDTADFLETPTANV

SEQ ID NO: 20420 - protein, 140 aa, Pectobacterium carotovorum subsp. carotovorum
RSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLS

SEQ ID NO: 20421 - protein, 353 aa, Neurospora crassa
MDYIPFLSGGVSFNPRTDIPSSALHGKTILVTGGNAGLGKQSILEFVRQPAASLPSRIWLCSRSLERAQSAIDDISAAVQSSGINSDFDASSIIKPLELDLTSFDSIKSAARTVLAESDRLDILMLNAGIMAAATGVTAEGYEIQFGTNHVGHALLTKLLLPLLLKTARSAKGNDLPQPADGTPTAPPDVRVVVLSSEGHRLPPLLGINFATLKSDQSSMLTWQRYGQSKLANILFGKQLAAHYPEELTVVALHPGAVNTQLFQPFRNSGWIGWAVTGFLKFFLSTVEDGAKNQVWAATAPREQVQSDGKGKCAYFLPVGKRVGESGWAKDEELASKLWQWTEGELEGQEVDA

SEQ ID NO: 20422 - protein, 474 aa, Tribonema intermixum
  unsure (1)..(474): unsure at all Xaa locations
RYESGVIPYAKMGYWDADYNVKHTDILALFRITPQPGVDPVEAAAAVAGESSTATWTVVWTDLLTACDIYRAKAYRVDPVPGTTDQFFAYISYQCELFEEGSIANLTASINGNXFGFKAVKALRLEDMRIPFAYLKTFQGPXXXXXXXXXXXXQFGRPLLGATVKPKLGLSGKNYGRVVYEGLRGGLDFLKDDENINSQPFMRWRERFLYCVEGINRSAAATGEVKGSYLNVTAATMEDMYERAEYAKNLGSIIVMIDLVIGYTAIQSMGIWSRKNDMILHLHRAGNFTYARQKXHGINFRVFGKWMRMAGVDHIDAGTVVGKLEGDPLMVKGFYNVLLNTNTEINLPQGLFFAMDWACLRKTVPVASGGIHCGQMHQLLYYLGXXXXXXFGGGTIGHXDGIQAGATANRVALESMVLARNEGRDYLNEGPQILRDAAKMCGPLKTALDLWKDITFDYTSTDTPDFVETATESK

SEQ ID NO: 20423 - protein, 208 aa, Thermobifida fusca
MFGFCRAHSRGFPYVRSVPHRSPMFSLARHRRSTAGTAAAVLLALTATGCGVLIGPSNGEVSDDITVTSPMLREGEKIPDRYTCAGEGMSPPLRWSGLPAETESLALVVDTVYESGGAAVHWVVYGLDPDNPELPEGTVPIPAQQGMNSFDTASYQPLCPEKGNEHEFRFTVYALSERVELGEAAPLDVALGAIATRTLARGRLTSVP

SEQ ID NO: 20424 - protein, 260 aa, Glycine max
FASLDRNEAEISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDSKRAMDEYTSEIFMGGKNTIVLHNTCEDSLLAAPIILDLVLLAELSTRIEFKAENEGKFHSFHPVATILSYLTKAPLVPPGTPVVNALSKQRAMLENILRACVGLAPDSIMILECK

SEQ ID NO: 20425 - protein, 445 aa, Eremothecium gossypii
MNKEKTVSFAPLQLRTGALPMMVVDNGMQRGMSGSWYAALSNFVELLDPIASQVHAYRRPSNEKIKTQDRDKRLHFRHRFNRSRGDLTPQLEAFKRKTLQKILAMDKPLQSIFFHNSSALDKAFYTFTLGNIFAMGSCWAVPELVHVYYTLTLTVLMFGRFYTYYKTNNHYFLADLCYFVNGLCLIYIWVLPQSVHLYQTCFAFSFGTLSFAVITWRNSLVIHSLDKITSCFIHISPPLTMYAIRHLVDESHKVRRFPAASKAMSPSWILTTNVLYTSVYYLIWQSLYHYFITLRKQEKIKAGERMTSFEYLTTHNFKDLWVLKLPAPWPMVLYTLFQYLYQLSTMILCVLWFKYKYAASMFLGMIFLIASRNGASYYIDYYGKRFEKEVRQLKTEVESLTQQLTEKYPAVTPGSEAFEDSDLPADVSSDTEGSCWETDVLADAE

SEQ ID NO: 20426 - protein, 483 aa, Rickettsia rickettsii
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPAVSFHPFTRTLHPNLNLTIIRENEEDLYAGIEYRQTHNMYESMKLISHTGCEKIIRYAFEYAVKNNRKKVMCLSKDNIMKFSDGVLHKVFNEIAKEYPQINNAHYIIDIGTARLATKPEIFDVIVTSNLYGDIISDVAAEISGSVGLAGSANIGQHYAMFEAVHGSAPDIAGKDIANPSGLLNAAIMMLVHIGQGDIATLIENAWKKTIEDGVHTADIYNEQSSSKKVGTKEFAEEVTKRLGQLPTKLPKADYPLIAEKQESNIDYKIDTKEVKKLVGTDIFVNMNVSSAHDIADKINKLDLGNFELKTISSKGLKLWPRDTRFETVSDHWCCRFMNKDGTEIKHLDITRLLEALSTANIDFIKVENLFEFDGVAGYSLAQGE

SEQ ID NO: 20427 - protein, 364 aa, GIBBERELLA ZEAE PH-1
MKGLILVGGYGTRLRPLTLSVPKPLVEFANKPMIVHQIEALVAAGVTDIVLAVNYRPEVMEKFLAEYEEKFGINIEFSVETEPLDTAGPLKLAERILAKDDSPFFVLNSDVICDFPFEDLLAFHKSHGNEGTIVVTKVEEPSKYGVVVHQPGHRSLIDRFVEKPVEFVGNRINAGLYIFNTSILDRIELRPTSIEKETFPAMVKDNQLHSFDLEGFWMDVGQPKDFLSGTCLYLSSLTKKGSKELTSPSEPFVHGGNVLIDPSAKIGKNCRIGPNVTIGPNVVIGDGVRLQRCVLLKGSKVKDHAWVKSTIVGWNSTIGRWARLENVTVLGDDVTVGDEIYVNGGSVLPHKSIKANVDIPAIIM

SEQ ID NO: 20428 - protein, 278 aa, Cladonia subtenuis
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNNETYKSDLEVISNASCTTNCLAPLAKVMHDEFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASNGELKGIMAYSEDDLVSTDLNGDNHSCIFDAKAG

SEQ ID NO: 20429 - protein, 764 aa, Xylella fastidiosa 9a5c
MSNDTFKQAAIDYHCTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVATMAPDPVIFALANPIPEIMPEAVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKAGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQIAEATLQACYRLKLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 20430 - protein, 163 aa, Zea mays
MDAVMFGLETPLMAALQHLLDVPDGDAGAGDNKTGGGGGATRTYVRDARAMAATPADVKELPGSYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 20431 - protein, 424 aa, Zea mays; identical to SEQ ID NO: 4311

SEQ ID NO: 20432 - protein, 496 aa, Neurospora crassa
MSTSVNINGVEFQPRLLINGEFVEASDKGTFNVVNPATGEMSCKVPEATEDDTNRAVAAAKAAQPGWAALDPAKRGAYLKKLAALIREHKSTLHHLEAISMGVPVNHFFHADFGADELDYFAEAWPHIQGQSSVNTPGYVTMTFRQPFGVAACIIPWNAPLYFFATKAAAALITGNTVVLKSSEKAPLAVAYAAELVAKAGFPPGVFNILSGHGLPSGRCLARHMDVRAISFTGSSRTGKLIQEEAAKTNLKSVTLELGGKSPAIIFDDANIEQALTDTMSSIVLNAGQVCIANSRVYVQKSVAPKFIEAFTKRMATIRGGNPLDPQTQMGPQADEIQYKNILSYIEEGKKSGKLAVGGKGQLDERKGYFVEPTVFLDTPEDAKIMKEEIFGPVLNINTFETEEEVVAKANDTEYGLWAAVFTNDLSRAMRMAKALESGYVSINCSSPSIGRDLPFGGYKGSGQGREGRLHSMNHFLEIKSVIIKLDEKASLQWNM

SEQ ID NO: 20433 - protein, 334 aa, Bacillus cereus ATCC 14579
MKKILLLATGGTIASVEGNEGLVPGLSAEELLNYFSKSSRNLEIDCKILMNIDSTNMQPEHWKEIANAVFNHYDDYDGFVITHGTDTLAYTSSALSYMLQGLRKPVVLTGSQVPISFKKTDAKKNVADALRFACEDVGGVFIVFDSRVIIGTRAVKMRTKSYDAFESVNYPYVAEVNEDEVKYHWKPTSSHNELSINTNLCTDVFLMKLYPGTKPEIFDCLKDLYKGIIIESFGNGGLLFEGRNLLSKIQELTEMGIAVVITTQCLEEGEDILLYEVGRKVAQHQVILSGDMNTEAIIAKLMWALGKTNKLEEIKKIIEEPLAYDLTIKSDKDW

SEQ ID NO: 20434 - protein, 494 aa, Neurospora crassa
MSSNVFVELKTPVTGTYKQPTGLFINNEFVEGVDKKTFEVINPATEEVICSVHEATEKDVDIAVAAARKAFEGVWRDVTPQQRGIYLLKLADLLEKNLDLLAAVESLDNGKSITMARGDVGAVVGTIRYYGGWADKIEGKTIDISPDSFHYTRQEPLGVCGQIIPWNFPLLMLAWKVGPALATGNTIVMKTAEQTPLSALVFAQFVKEAGFPPGVLNIISGFGRIAGAAMASHMDIDKVAFTGSTMVGRQIMKAAAESNLKKVTLELGGKSPNIIFNDADIDQAIDWVNFGIYFNHGQTCCAGSRVYVQEGIYDKFVAAFKQRAQQNKVGDPFHDETFQGPQVSQLQYDRIMGYIKAGKEEGATVETGGERHGDKGYFIQPTIFTNVRHDMKIMKEEIFGPVCAVAKFSTEEEVIKLGNDSNYGLAAAVHTKDLNTAIRVSNHLRAGTVWVNTYNALHHQLPFGGYKESGIGRELGEAALANYTQCKSVAIKLN

SEQ ID NO: 20435 - protein, 547 aa, Schizosaccharomyces pombe
MGKTLTIVMLVFVSMAGWMFGADTGSIGGITNMRDFQSRFADRYNPVTDTYSYSSARQGLITGMVNVGSMTGCILSSPLMDRIGKRVSIMFWTIVYLIGIILQVTAVPSWVQIMVAKIWTGLAIGALSVLAPGFQSEVAPATLRGTIVTTYQLAVTGGIFIAACINMGTHKLHKTAQWRVSMGINLLWGIIMFIGISFLPESPRYLIAIGKDEEALDIMCKNNVLPREHEIIQTEYHVIKTDCEAEMAGGPATWGDILGADIRYRTFLGLGVMSLQQLTGDNYYFYYGFEVFEGTGMNSPYLSALILDAVNFGCTFGGLFVLEFFGRRMPLIIGGVWQSITFFIYAAVGNRALTRKNGTSNHRAGAVMIVFSCLFIFSFAQTWGPAAYVIVGESYPIRYRSKCAAVATTGNWLWGFLITFFTPFISDSIGFKYGYIFAACNLCAACIIFLFAHETKGLTLEEINELYLSGAKPWMPRPENLGQAAKQQQEVLEKSRGVQGESAAHLENVDNEGMEDTSSNDITSSTSSSEGRAKPESNYVDEQDRYA

SEQ ID NO: 20436 - protein, 222 aa, Saccharomyces cerevisiae
MSNEDYGYDYDYLFKIVLIGDSGVGKSNLLSRFTTDEFNIESKSTIGVEFATRTIEVENKKIKAQIWDTAGQERYRAITSAYYRGAVGALIVYDISKSSSYENCNHWLTELRENADDNVAVGLIGNKSDLAHLRAVPTDEAKNFAMENQMLFTETSALNSDNVDKAFRELIVAIFQMVSKHQVDLSGSGTNNMGSNGAPKGPTISLTPAPKEDKKKKSSNCC

SEQ ID NO: 20437 - protein, 179 aa, Triticum aestivum
MQSQIVCHGCRSVLLYPRGAPSVCCAVCHAVTSAPPPGMEMAQLICVGCRTLLMYTRNATTVRCSCCDTVNLARPAPPVNSIAHVNCGQCQTVLMYPYGASSVKCAICNFITNIGMNTVRPLPPTMHAPNGISYSVPSTSAPSAQSQNVTVVVENPMTVDDKGKLVSNVVVGVTSGGKK

SEQ ID NO: 20438 - protein, 351 aa, Eremothecium gossypii
MSAPTIPRTQKAVIFYENGGPLQYTDIEVPKPKATELLINVKYSGVCHTDLHAWKGDWPLPTKLPLVGGHEGAGVVVAMGENVRGWKIGDLAGIKWLNGSCMACEYCEKSNESNCPEADLSGYTHDGSFQQYATADAVQAAHIPAGTDLAQVAPILCAGITVYKALKSANLRAGDWVAISGACGGLGSLAIQYATAMGYRVLGIDGGEEKEQLFRQLGGEVFIDFRKSKDIVADVVKATNGGAHGVINVSVSEAAIESSTEYVRSNGTVVLVGLPGGAKCKSDVFSHVVKSISIVGSYVGNRADTREALDFFARGLVKSPIQVVGLSELPQIYEKMEKGAVVGRYVVDTSM

SEQ ID NO: 20439 - protein, 165 aa, Zea mays
MDGRMFGLETPLMVALQHLLDVPDGDAGAGGDKASGAAAGGGPTRTYVRDARAMAATPADVKELPGVYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 20440 - protein, 155 aa, Glycine max
GWAGFNGGDPYAANTDSSMAVLNTNICAATSLLVWTWLDVIFFKKPSVIGAVQGMITGLVCITPGAGLVQGWAAIVMGVLSGSVPWFSMMVLGKKLKLFQMVDDTLAVFHTHAVAGLLGGILTGLFAEPRLCALFLPVTHSKRGVYGGPGGVQIP

SEQ ID NO: 20441 - protein, 453 aa, Halobacterium sp. NRC-1
MDDINPATGARIDTYETDTAADIEAALARAADAANDWRDRPIRERERHVAAAGDVLRENTQTYAELITAEMGKPITQARAEIEKCAAVCDHYATHASAYLQPDGHPSPAGADVQTVYEPLGPVLAVMPWNFPFWQVFRFAAPALAAGNVALLKHASNVPGCAEAIADVFEAAGLPAGVFQTLLVGADAVEDVIRDDRVRAATLTGSEPAGSAVAATAGETLKKTVLELGGSDPFVVLDDADVAAAAASGAWARTLNSGQSCIAAKRFIVHTDVYEAFRDAFVSEIDSLTVGDPTREETDVGPQASAAGLDTTHEQVRASVDAGATVVTGGQPSDREGAFYEPTVLTDVPAGCPADTEELFGPVAAVFEVPDEAAAIAKANATAFGLGASVWTADRDRGRRVARAMDAGCAYVNQPVTSDPRVPFGGIGRSGYGRELAGAGIRAFVNRKTLWVE

SEQ ID NO: 20442 - protein, 300 aa, Zea mays
GFFVRPKDAKNDFFITGESYAGHYIPAFASRVHQGNKNNEGIHINLKGFAIGNGLTDPAIQYKAYPDYALDMGLITKTQFNRINKIVPTCEFAVKLCGTSGTVSCLAAYFVCNTIFSAIRTIIGNKNYYDIRKPCIGSLCYDFSNLEKFLNLKSVRESLGVGDIEFVSCSPTVYEAMLLDWMRNLEVGIPELLESDIKVLIYAGEYDLICNWLGNSRWVNSMEWSGKEAFVSSSEKPFTVDGKEAGVLKNHGPLSFLKVHDAGHMVPMDQPKAALEMLKRWTSGNLSEPSSSSQRLDFTM

SEQ ID NO: 20443 - protein, 335 aa, Thermotoga sp. KOL6
STFVAGLEKLKKGEIEPYGVPLADELPIGFGDIKIVGSYDVDKSKIGKKLSEVVKRYWNDVESFSDDPIISQGVHLGSVEKLPVEAEGLEEKMTLKEVVDRLVDEWTKLDPDVIVNTCTTEAFKPFDNKEDLMKSIENNETERLSATQVYAYAAALYASKRGGAVFVNVIPTYIANDPAFVELAKENKLIVLGDDGATGATPFTADVLSHLVQRNRYVKDVAQFNIGGNMDFLALTDEGKNKSKEFTKSSIVKDILGYDAPHYIKPTGYLEPLGDKKFIAVHIEYVSFNGATDELMINGRINDSPALGGLLVDLVRLGKIALDRREYGTVYPINA

SEQ ID NO: 20444 - protein, 335 aa, Chondrus crispus
MTAPKVGINGFGRIGRLVLRAAIEKGTCQVVAINDPFIDLDYMAYMLKYDSTHGRYAGDVSIKDGKLQVDGNSITVFAHRDPAEIPWATAAADYIVEATGVFTLKDKAAAHFKGGAKKVVISAPSKDAPMFVCGVNEAKYTPDLDIISNASCTTNCLAPLVKVIHEKYGIEEGLMTTVHATTATQKTVDGPSNKDWRGGRGRGRNIIPSSTGAAKAVGKVMPELNGKLTGMAFRVPTPDVSVVDLTVRLTSETTYEDIKATMKAAADDSMKGIMKYTEDAVVSTDFIHDDASCIFDASAGIMLNSKFCKLVAWYDNEWGYSNRVVDLIAHISKVQ

SEQ ID NO: 20445 - protein, 217 aa, Enterococcus faecalis V583
MKLAPSILSADFANLERDIRLVEELGADYIHVDVMDGQFVPNITLGPNIVSAIRPVTKLPLDVHLMIVQPENYINAFAEAGADIITVHQEATPHIHRALQMIKNAGVKAGVTINPGTPLSMIENVLDLADQVLVMTVNPGFGGQSFIENSLEKIAQLKEWKETKGYTYEIEVDGGIVPETAARCKEAGAEVFVAGSYIYNAENPQERIDALRAVLDK

SEQ ID NO: 20446 - protein, 340 aa, Acinetobacter sp. M-1
MSNHQIRAYAAMQAGEQVVPYQFDAGELKAHQVEVKVEYCGLCHSDLSVINNEWQSSVYPAVAGHEIIGTIIALGSEAKGLKLGQRVGIGWTAETCQACDPCIGGNQVLCTGEKKATIIGHAGGFADKVRAGWQWVIPLPDDLDPESAGPLLCGGITVLDPLLKHKIQATHHVGVIGIGGLGHIAIKLLKAWGCEITAFSSNPDKTEELKANGADQVVNSRDAQAIKGTRWKLIILSTANGTLNVKAYLNTLAPKGSLHFLGVTLEPIPVSVGAIMGGAKSVTSSPTGSPLALRQLLQFAARKNIAPQVELFPMSQLNEAIERLHSGQARYRIVLKADFD

SEQ ID NO: 20447 - protein, 82 aa, Phaseolus vulgaris
GFAWRWGPLGWLVPSEIFPLEIRSAAQSINVSVNMFFTFVIAQVFLTMLCHMKFGLFIFFAFFVVVMTFFIFFFLPETKGIP

SEQ ID NO: 20448 - protein, 515 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEQPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGGELNHKT

SEQ ID NO: 20449 - protein, 288 aa, Synechocystis sp. WH 8501
MAKIRVGINGFGRIGRLVFRAGINNPDFEFVGINDLVPAKNIAYLLKYDSTHGRFDGTVEATDEGIVVNGKLIPCFAIRNPEELPWGQLEVDYVVESTGLFTTHETASKHLKAGAKRVVISAPTKDPEKVNTFVVGVNDDQYDPTKDYIVSNASCTTNCLAPIAKVINDNFGLAEGLMTTVHAMTATQPTVDGPSKKDLRGGRGAAQNIIPASTGAAKAVTLVIPELKGKLTGMALRVPTPDVSVVDLTFKTEKATSYEAICAAMKAAANGELKGVLGYTDEDVVSMD

SEQ ID NO: 20450 - protein, 483 aa, ASPERGILLUS NIDULANS FGSC A4
MASGTLPPFPTKLFINNQVENTPHPSTLLPADRMIINLVERDAERLAILESLPTGKPVTPTIHFDIAHMLEVWRYYAGWTDKISGESYPESNGVYKIVRHEPLGVCAGIASWNATFMYIGWKIAPAVAAGNCFIFKPSEKSPFGTLALGALFAEAGFPAGVVQILNGGAETGAALARHMDIAKISFTGSLGGGKAVQEAATKSNLKKVTLELGGKSPAVVFADAELERALGGVCGFLFNSGQVCVATSRVLVQKPIFEKFTQGLKSAFEQTSSTLGADPLDKNVSYGPIVDKAQFDKIMSYIAIGKQTATLLTGGERKGDKGFFIKPTIFVNPEPESPIVKEEIFGPVMVVQTFETEEEAIALANATVYGLAASVYTSNIDRALRVSSALECGGVAVNSPFLPQVNTAFGGIKASGKGRELGLYGLLEYTEAKSVHITCCVNRGGWNDLGTQPDQLQTAGSVMNCLRQEAETIWIDEAYRTST

SEQ ID NO: 20451 - protein, 1565 aa, Arabidopsis thaliana
MWKLKIANGNKEEPYLFSTNNFLGRQTWEFDPDAGTVEELAAVEEARRKFYDDRFRVKASSDLIWRMQFLKEKKFEQVIPPAKVEDANNITSEIATNALRKGVNFLSALQASDGHWPAENAGPLFFLPPLVFCLYVTGHLHEIFTQDHRREVLRYIYCHQNEDGGWGLHIEGNSTMFCTTLNYICMRILGEGPNGGPGNACKRARDWILDHGGATYIPSWGKTWLSILGVFDWSGSNPMPPEFWILPSFLPIHPAKMWCYCRLVYMPMSYLYGKRFVGPISPLILQLREEIYLQPYAKINWNRARHLCAKEDAYCPHPQIQDVIWNCLYIFTEPFLACWPFNKLLREKALGVAMKHIHYEDENSRYITIGCVEKALCMLACWVEDPNGIHFKKHLLRISDYLWIAEDGMKMQSFGSQLWDSGFALQALVASNLVNEIPDVLRRGYDFLKNSQVRENPSGDFTNMYRHISKGSWTFSDRDHGWQASDCTAESFKCCLLLSMIPPDIVGPKMDPEQLYEAVTILLSLQSKNGGVTAWEPARGQEWLELLNPTEVFADIVVEHEYNECTSSAIQALILFKQLYPNHRTEEINTSIKKAVQYIESIQMLDGSWYGSWGVCFTYSTWFGLGGLAAAGKTYNNCLAMRKGVHFLLTTQKDNGGWGESYLSCPKKRYIPSEGERSNLVQTSWAMMGLLHAGQAERDPSPLHRAAKLLINSQLENGDFPQQEITGAFMKNCLLHYAAYRNIFPVWALAEYRRRVPLPYEKPSTERRKMRYVAHIFVMWRLKIGEGNGDDPYLFTTNNFAGRQTWEFDPDGGSPEERHSVVEARRIFYDNRFHVKASSDLLWRMQFLREKKFEQRIAPVKVEDSEKVTFETATSALRRGIHFFSALQASDGHWPAENAGPLFFLPPLVFCLYITGHLDEVFTSEHRKEILRYIYCHQKEDGGWGLHIEGHSTMFCTTLNYICMRILGESPDGGHDNACGRAREWILSHGGVTYIPSWGKTWLSILGVFDWSGSNPMPPEFWILPSFFPVHPAKMWSYCRMVYLPMSYLYGKRFVGPITSLILQLRKELYLQPYEEINWMKVRHLCAKEDTYYPRPLVQELVWDSLYIFAEPFLARWPFNKLLREKALQLAMKHIHYEDENSRYITIGCVEKVLCMLACWVEDPNGDYFKKHLSRISDYLWMAEDGMKMQSFGSQLWDTGFAMQALLASNLSSEISDVLRRGHEFIKNSQVGENPSGDYKSMYRHISKGAWTFSDRDHGWQVSDCTAHGLKCCLLFSMLAPDIVGPKQDPERLHDSVNILLSLQVSIIRHRIEPTSSKKHPFSGRDSFTCLQSKNGGMTAWEPAGAPKWLELLNPTEMFSDIVIEHEYSECTSSAIQALSLFKQLYPDHRTTEITAFIKKAAEYLENMQTRDGSWYGNWGICFTYGTWFALAGLAAAGKTFNDCEAIRKGVQFLLAAQKDNGGWGESYLSCSKKIYIAQVGEISNVVQTAWALMGLIHSGQAERDPIPLHRAAKLIINSQLESGDFPQQQATGVFLKNCTLHYAAYRNIHPLWALAEYRARVSLP

SEQ ID NO: 20452 - protein, 430 aa, Rhodomela confervoides
  unsure (1)..(430): unsure at all Xaa locations
AAVAGESSTATWTVVWTDLLTACDLYRAKAYKVDAVPNTSDQYFAYIAYDIDLFEEGSIANLTASIIGNVFGFQAVKALRLEDMRLPVAYLKTFQGPATGIIVERERMDKFGRPFLGATVKPKLGLSGKNYGRVVYEGLKGGLDFLKDDENINSQPFMRWKERFLYAMEAVNRSIAATGEXKGHYMNVTAATXXXMXERAXFAKQLGTVIIMIDLVIGYTAIQSMAIWSRRNDMILHLHPAGNSTYSRQKIHGMNFRVICKWMRMAGVYHIHAGTVVGKLEGDPPMIQGFYDTLLDLISEVDLPKGIFFQQDWASLRKVTPVASGGIHCGQMHQLLDYLGNEVVLQFGGGTIGHPDGIQAGATANRVALEAMVIARNEGRDYVTEGPQILQDTAKTCGPLQTALDLWKDISFNYTSTDTPDFVETPTANV

SEQ ID NO: 20453 - protein, 482 aa, Oryza sativa
MPEKAVDDVMDSAVGAHFSGLRLEALRLSSPSAPSSPSSAKAAAAAAAHSNGASPSALRQPFVIGVSGGTASGKTTVCDMIIQQLHDHRVVLVNQDSFYRGLTAEESAHAQDYNFDHPDAFDTEQLLECMGQLKRAQPVNVPIYDFKNHRRSSESFRKVNASDVIILEGILVFHDQRVRNLMDMKIFVDTDADIRLARRIRRDTVERGRDVSSVLEQYGRFVKPAFDDFVLPSKKYADVIIPRGGDNHVAIDLIVQHIRTKLGQHDLCKIYPHVYVVQTTFQIRGMHTLIRDRDITTPDFVFYSDRLIRLVVEHGLGHLPFTEKQIITPTGSIYMGVEFCKKLCGVSIVRSGESMENALRACCKGIKIGKILIHRVGDNGQQLIYHKLPMDIAERHVLLLDPVLGTGNSANQAIELLIRKGVPEERIIFLNLISAPEGIQCVCKRFPRLKIVTSEIDTGLSEEYRVIPGLGEYGDRYFGTDN

SEQ ID NO: 20454 - protein, 490 aa, Phaeodactylum tricornutum
MSQSVSERTRIKSDRYESGVIPYAKMGYWDAAYAVKNTDVLALFRITPQPGVDPVEAAAAVAGESSTATWTVVWTDLLTACDRYRAKAYRVDPVPNTTDQYFAFIAYECDLFEEGSLANLTASIIGNVFGFKAVSALRLEDMRIPHSYLKTFQGPATGVIVERERLNKYGIPLLGATVKPKLGLSGKNYGRVVYEGLKGGLDFLKDDENINSQPFMRWRERFLYCMEGINRASAATGETKGSYLNITAGTMEEVYKRAEYAKTVGSIVVMIDLVMGYTAIQSAAIWARDNDLILHLHRAGNSTYARQKNHGINFRVICKWMRMCGVDHIHAGTVVGKLEGDPLMIKGFYDTLLLTHLNVNLPYGIFFEMTWASLRKCMPVASGGIHCGQMHQLVHYLGDDVVLQFGGGTIGHPDGIQAGATANRVALEAMILARNEGADYFNSDIGPQILRNAAKTCGPLQTALDLWKDISFNYTSTDTSDFSVTPTANV

SEQ ID NO: 20455 - protein, 199 aa, Triticum aestivum
  unsure (1)..(199): unsure at all Xaa locations
NQLFQLKFTAKQLNKQSKRCQKDEQTEKNKLKKSIQDGNMEGARIYASNAIXRKKNEALNLLKLSSRIDAVASRVQTAITMRKVSNSMASVVKGMGRAMETMNLEQISMVMDKFESQFEDLDVQTGYMEGAMAGTTTLNTPQDEVESLMHQVADEHGLELNDTLNELEPSKTLADGSASKQKEKDEDKMLTERLRALRQ

SEQ ID NO: 20456 - protein, 312 aa, Enterococcus faecium
MKVKKAVIPAAGLGTRFLPATKAMAKEMLPIVDKPTIQFIVEEALKSGIEDILIVTGKAKRPIEDHFDSNIELETNLSEKGKTELLKLVEETTDVNLHFIRQSHPKGLGHAVLQARAFIGNEPFVVMLGDDIMEDEVPLTQQLIDDYERTHASTIAVMQVPHDETSKYGIINPGEVLEDGLYNVKNFVEKPDPSKAPSDLAIIGRYLLTPEIFDVLSEQQPGAGNEIQLTDAIDTLNKTQRVFARKFTGKRYDVGDKFGFMKTSIEYGLTHPEVGAPLREYILSLGKTLEAEGSKIDHNPKGITEIKEEKKK

SEQ ID NO: 20457 - protein, 203 aa, Zea mays
EFPGRPTRPRTRGRTRGDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSRVEISQYLPLLLKLVVLAYAALCLGELLHRWSSGGSCSLSPWCA

SEQ ID NO: 20458 - protein, 417 aa, Oryza sativa
  unsure (1)..(417): unsure at all Xaa locations
AAGFGTSLLDLIVGHGVAMLSAATVPLQXGGGLSDFSGLRSSSSLPLRRDATSDNFMNPVSFRTHAVGTNGGARRAPTEAKLKVAINGFGRFGRNFLRCWHGRGDDSPLNIIPINDTGGVKQASHRLKYNSTLGIFDADVKPVGENPLSVEGEVIKVVSDRNPSNLPWGELGIELLIEGTGLFFNANGAGKHIQAGAKKVLITAPGKGDIPTYVVGVNADQYSPDEPIISNASCTTNCLAPFVKILDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDSAANELKGILEVCDVPLVSVDFRCSDVSCTIDASLSMVMGDDMVKVIAWYDNEWGYSQRVVDLADIVANQWK

SEQ ID NO: 20459 - protein, 410 aa, Pseudomonas putida KT2440
MNEYAPLRLHVPEPTGRPGCQTDFSYLRLNDAGQARKPAIDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQAVTAELEAAVIAAQKEAEQYGTLANGHIPSAASMFEDVYKEMPDHLRRQRQELGV

SEQ ID NO: 20460 - protein, 339 aa, Bacteroides thetaiotaomicron VPI-5482
MKEIDWANLSFGYMKTDYNVRINFRNGAWGELEVSSDEHLNLHMAATCLHYGQEAFEGLKAFRGKDGKVRIFRLEENAARLQSTCQGILMAELPTERFKEAILKVVKLNERFIPPYETGASLYIRPLLIGTSAQVGVHPAEEYMFVVFVTPVGPYFKGGFSTNPYVIIREFDRAAPHGTGIYKVGGNYAASLRANKKAHDLGYSCEFYLDAKEKKYIDECGAANFFGIKDNTYITPKSSSILPSITNKSLMQLAEDMGIKVERRPIPEEELETFEEAGACGTAAVISPIQRIDDLENGKSYVISKDGKPGPICTKLYNKLRGIQYGDEPDTHGWVTIVE

SEQ ID NO: 20461 - protein, 436 aa, Glycine max
MAGAVVLLLVAELPVTLRLGSLEIRSCSMVKDSADADSHHRRLGLLKDQVHLVKRKGSDRYEIAPIQDQLSFGKGFFIVIRACDGIILVGVAGPSGAGKTIFTEKILNFMPSIAIISMDNYNDASRIVDGNFDDPRLTDYDTLLQNLHNLKEGKPVQVPIYDFKSSSRTGYRTVEAPSSRIVIIEGIYALSEKLRPLMDLRVSVTGGVHLDLVKRVIRDIQRAGQEPEEIIHQISETVYPMYKAFIEPDLQTAHIKIINKFNPFTGFQSPTYILKSGRNVEVDKIKAVLAEDFKETTEQTYDIYLLPPGEDPETCQSYLRMRNKDGKYSLMFEEWVTDNPFVISPRITFEVSVRLLGGLMALGYTIATILKRNSHVFSDDRVCVKLDWLEQLNRHYVQVQGRDRLVLKYIGEQLGLEGSYIPRTYIEQIQIEKLVN

SEQ ID NO: 20462 - protein, 201 aa, Glycine max
  unsure (1)..(201): unsure at all Xaa locations
MADQGLEGSQPVDLQKHPSGIVPTLQNIVSTVNLDCKLDLKTIALQARNAEYNPKXRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 20463 - protein, 397 aa, Zea mays
MAPTQALSSVNKVDPRLAVEQNGQNADATTNGASATTLEATQPVSPWGDVDHLLDGYDDQQKALIQKERARRITEQHKMFSARKLCLVLDLDHTLLNSAKFIEVEPIHEEMLRKKEEQDRTLPERHLYRFHHMNMWTKLRPGIWNFLQKASNLFELHLYTMGNKLYATEMAKVLDPTGTLFAGRVISRGDDGDPFDSDERVPKSKDLDGVLGMESAVVIIDDSVRVWPHNRHNLIVVERYTYFPCSRRQFGLPGPSLLEIDRDERPEDGTLASSLAVIERIHHNFFSHPNLNEADVRSILASEQRRILTGCRIVFSRVFPVGDASPHLHPLWQTAEQFGAVCTNLVDDRVTHIVANSPGTDKVNWALSKGKFVVHPGWVEASALLYRRANEHDFAVK

SEQ ID NO: 20464 - protein, 302 aa, Streptococcus sobrinus
LDSQKEICVLGGSKIGLVELPWALMNPGDLLLLPDPGYPDYLSGVALGRVDYETFPLLAENDFLPDLAAIPEEIARRAKFIYINYPNNPTGRVATSDFYQDLVAWAKKYQVGVVSDFAYVPWATRAMKILAFCLHRGPRRSVLNSIPSPRPLTWPAGRLAFAAGNADMIEALNLIQDHLFVSIFPAIQDAGVAALLDPQAKEAIVQLNQIYDQRREAFVQASAKIGWQAFPSKGSFYAWMPVPRGYTSQSFADLLLEKAHVAVAPGVGFGQAGDGYVRIGLLVEPERLAEAVERIGALNLFG

SEQ ID NO: 20465 - protein, 480 aa, Ahnfeltiopsis gigartinoides
FRVQNERYESGVIPYAKMGYWDPDYVVKDTDVLALFRVTPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEDMYERAEFAKQLGSIIIMIDLVIGYTAIQSMAIWARKNDMILHLHRAGNSTYSRQKSHGMNFRVICKWMRMAGVDHIHAGTVVGKLEGDPLMIKGFYNTLLLPYLEVNLPQGIFFEQDWASLRKVTPVASGGIHCGQMHQLLDYLGNDVILQFGGGTIGHPDGIQAGAIANRVALETMVLARNEGRDYVTEGPQILQDAAKTCGPLQTALDLWKDISFNYTSTDTADFVETPTANV

SEQ ID NO: 20466 - protein, 371 aa, Schizosaccharomyces pombe
MCAKKIVVLPGDHIGPEIVASALEVLKVVEKKRPELKLEFEEHKIGGASIDAYGTPLTDETVKACLEADGVLLGAVGGPEWTNPNCRPEQGLLKLRKSMGVWANLRPCNFASKSLVKYSPLKPEIVEGVDFCVVRELTGGCYFGERTEDNGSGYAMDTWPYSLEEVSRIARLAAWLAETSNPPAPVTLLDKANVLATSRLWRKTVAKIFKEEYPHLTLKNQLIDSAAMLLVKSPRTLNGVVLTDNLFGDIISDEASVIPGSLGLLPSASLSGVVGKSEEKVHCLVEPIHGSAPDIAGKGIVNPVGTILSASLLLRYGLNAPKEAEAIEAAVRKVLDDTSIGGRGLYTRDLGGEASTADITKAVVEELEKIL

SEQ ID NO: 20467 - protein, 360 aa, Triticum aestivum
  unsure (1)..(360): unsure at all Xaa locations
MASGMQHKNAISTATEGLIQAQLELYHHSLGYVKSVALRAATELGIPDAIHRHGGVATLSDIATETGIHPSKYSHLRRLMHALAVTGIFSVEGSDDDAGYKLTAVSSILVEGGESMCNLSPMVHVLVELLKLTMLCSIKEWFTDERASAMTLFEVAHGCTPSEMKAKKGTVGMFQAAMVADSNLVMEVVLKEHIGIFKGVSSLVDAGGGHGAAAAAIAKALPHVKCTVLDLPHVIAGAPTXRDVQFVAGDVFEYVPQADAILLKWILTMWQDEGAVNILRRCKEAIPAGGKVIIFDGMVDSGTSQDVILKETQVLFDIVMMGVDGVERDEQQWKKIFVEAGFGDYKITPVGHRSIIEVYP

SEQ ID NO: 20468 - protein, 488 aa, Chordaria chordaeformis
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENFNSQPFMPWKERFLYWMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTLVGKLEGDPLMVKGFYNSLLLTHLKINLAEGLFFDMDWPALRKCVPVASGGIHCGQMHQLLYYLGDDVVLQFGGGTIGHPDGIQSGATANRVALESMVLARNEGRDYVGEGPEILRRAAPTCGPLKAALDLWKDITFDYTSTDTPDFVEVATESR

SEQ ID NO: 20469 - protein, 484 aa, Corynebacterium glutamicum ATCC 13032
MTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 20470 - protein, 219 aa, Zea mays; identical to SEQ ID NO: 15550

SEQ ID NO: 20471 - protein, 143 aa, Triticum aestivum
MVRAPRLPEMTRRRRGGGAIGRKRLMCSAKEVDECCTSVAVKGHCAMYTADGRRFEVPLAYLSTTIIGELLRMSQDEFGFTSDGRITLPCDAAVMDYVMCLLRRNASEEVERAFLSSVVRPCHYGNGLEPSMGVSQQVAVSGF

SEQ ID NO: 20472 - protein, 728 aa, Candida albicans
MYYSEEIGLPKTDISRWRLRSDALGRETWHYLSQSECESEPQSTFVQWLLESPDFPSPPSSDIHTSGEAARKGADFLKLLQLDNGIFPCQYKGPMFMTIGYVTANYYSKTEIPEPYRVEMIRYIVNTAHPVDGGWGLHSVDKSTCFGTTMNYVCLRLLGMEKDHPVLVKARKTLHRLGGAIKNPHWGKAWLSILNLYEWEGVNPAPPELWRLPYWLPIHPAKWWVHTRAIYLPLGYTSANRVQCELDPLLKEIRNEIYVPSQLPYESIKFGNQRNNVCGVDLYYPHTKILDFANSILSKWEAVRPKWLLNWVNKKVYDLIVKEYQNTEYLCIAPVSFAFNMVVTCHYEGSESENFKKLQNRMNDVLFHGPQGMTVMGTNGVQVWDAAFMVQYFFMTGLVDDPKYHDMIRKSYLFLVRSQFTENCVDGSFRDRRKGAWPFSTKEQGYTVSDCTAEAMKAIIMVRNHASFADIRDEIKDENLFDAVEVLLQIQNVGEWEYGSFSTYEGIKAPLLLEKLNPAEVFNNIMVEYPYVECTDSSVLGLTYFAKYYPDYKPELIQKTISSAIQYILDSQDNIDGSWYGCWGICYTYASMFALEALHTVGLDYESSSAVKKGCDFLISKQLPDGGWSESMKGCETHSYVNGENSLVVQSAWALIGLILGNYPDEEPIKRGIQFLMKRQLPTGEWKYEDIEGVFNHSCAIEYPSYRFLFPIKALGLYKNKYGDKVLV

SEQ ID NO: 20473 - protein, 147 aa, Salmonella enterica
ATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 20474 - protein, 342 aa, Zea mays
MPFSSDEYQKCLARVPFLFHPTLQLVCRSWRASVCSGELLKIRNQIGTTEELLCVLAFEPENMWQLYDPLRDKWITLPVMPSQIRNIARFGVASVAGKLYVIGGGSDRVDPLTGDHDRIFASNEVWSYDPLHRVWSQRAPMLVARAMFACCALDGKIIVAGGFTNCRKSISKAEIYDPEAGIWEPLPDLRLAHSSACTGLVIKGKMHVLHKGLSTVQILEDGGSHWAVEDFSWLQGPMAMVGGELYVLSNSCIMKQRGENFPDKMVSCASEFQSRIGFGMIGVGDNIYLVGGVIGPGPRNQCIKLLSDVDILNVTSERPTWRPGSPMTHCRGSICGCALLRI

SEQ ID NO: 20475 - protein, 107 aa, Zea mays
VSDPSGFAVKWYTRKGNWNLVGNNFPVFFIRDGIKFPDVIHPFKPNPRTDVQEDRRVFHFLWGPPRSLNTFFFLLDEPGVSLHYPPKEGFGVNTFTIHERGEEGAAP

SEQ ID NO: 20476 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 20477 - protein, 289 aa, Burkholderia pseudomallei
MRALRKARLVLHLLRGMATVALRFERATPERRRDLTRRWTLKMLQLCGMRLVVHNDAARLDARALVVGNHVSWLDIYVINAWRPTPFVSKAEVRAWPVVGWLAERLGTVFIQREKRSEAKRIMHELSERLGNGELMCVFPEGTTSDGLGLLPFHSNLFQAVVSADCSVQPICLMYEDARGRQSVAPAYVGDLPLGKSLDMVLANGPLTAHLYVCEPIAATGDRREMAALARASVADALARMQAGVERPLDADLARLAAAAYPTPAEPAGEPVAVAEPEVGADAISRREG

SEQ ID NO: 20478 - protein, 405 aa, Glycine max
MVLEATMICIDNSEWMRNGDYSPSRFQAQADAVNLICGAKTQSNPENTVGVLTMAGKGVRVLVTPTSDLGKILACMHGLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAATAAAGGVSGFEFGVDPNLDPELALALRVSMEEERARQEAAAKKAAEDAAKQEKGGEQQASSQDATMTEGASAAASEAENKTSDLMDDENALLQQALAMSMDDPTISHDVKDTDMSEASASDPDLALALQLSIADSAKDQSSQSDMSKLLADQSFVSSILASLPGVDPNDPSVKDLLASMQNQSEPQQKNDDKPSNEEEKK

SEQ ID NO: 20479 - protein, 537 aa, Nicotiana tabacum
MAKDQLQVLNALDVAKTQLYHFTAIVIAGMGFFTDAYDLFCISLVTKLLGRIYYHHDGAPKPGTLPPNVSAAVNGVAFCGTLAGQLFFGWLGDKMGRKRVYGMTLMMMVICSIASGLSFGHTPKSVMTTLCFFRFWLGFGIGGDYPLSATIMSEYANKKTRGAFIAAVFAMQGFGILAGGMVAIIVSAAFKGAFPAQTYQTDPLGSTVSQADFVWRIILMFGAIPAAMTYYWRMKMPETARYTALVAKNLKQAANDMSKVLQVDIEEEQEKVENVSQNTRNEFGLFSKEFLRRHGLHLLGTASTWFLLDIAFYSQNLFQKDIFSAIGWIPPAQTMNALEEVYKIARAQTLIALCSTVPGYWFTVFFIDKIGRFAIQLMGFFFMTVFMFALAIPYHHWTLKDNRIGFVIMYSLTFFFANFGPNATTFVVPAEIFPARLRSTCHGISAAAGKAGAMIGAFGFLYAAQPTDRKKADAGYPAGIGVRNSLIVLGCVNFLGMVFTFLVPESKGKSLEEMSRENEGEEESGTEMKNSGRTVPV

SEQ ID NO: 20480 - protein, 204 aa, Glycine max
MGFNILRTTSISTPISSSKSKPIFSTLLRSSPSTIFPPKSVTPTTLFVSATPFFTLHPKLGFRGGIVAMAAPGSLRKSEEEWRAILSPEQFRILRQKGTEFPGTGEYDKFYEEGVYNCAGCGTPLYRSITKFNSGCGWPAFYEGIPGAINRNPDPDGMRTEITCAACGGHLGHVFKGEGFPTPTNERHCVNSISLKFAPANSYS

SEQ ID NO: 20481 - protein, 304 aa, Dechloromonas sp. RCB
MPQKALSLTYAKLVAAMFMWGGTWIAGRIIAQELSAPLAVASIRFVVTALALAGFALLTGKGAPAPKTTREWGVVSGLGFFGIFLYGLCFFFGLQHITAGRGALVVALNPVVIVLAAWLFGHERMNRRKALGSAIALAGCLTVIGNGNPLALVEGTVGIGEWLIVGCVMSWTAYTFIGRMATRTLSPLATTLYASLIGALLLGLAALVQGDIAPASWSWRVWTGLFFLAIFGTAIAYTWFTEAVHTLGAGHASVFINLVPVFAVLQAALLLDERLGLPVLFGGLLVIAGVWLTTKQKISLEISK

SEQ ID NO: 20482 - protein, 145 aa, Zea mays; identical to SEQ ID NO: 15739

SEQ ID NO: 20483 - protein, 368 aa, Rhizobium sp. NGR234
MERTMSDAKLQRVLSSLTEVYRQLNSLPSSQPSDAGYVKLDTNENPFALPKAVMQSAVAALERQYLYPEDDNISLREAAAASYDLSADQVIAGNGSSELLSLIYKAFLGPGDSVAMLSPGFAYNRKLAQLQGARLLEIKWGESSLLPIHELLFGPAKQAKFILLANPNNPTGTFVPIADIESLVALSDQLVVLDEAYVDFAPDSALRLVNRYSNLLLLRTFSKSYAAAGIRVGFGFGHPEVIGRLRNIQNMFNMNVIGHAVGVSILAHRATYNENHRHIRHERERVRVALSRLGFSVTPSHANFLLARVPAGRDGVWWHACLKRKKILVAVLPDEGLEDCIRVSIGTKPQMDAFLAAVEDISGAQQSR

SEQ ID NO: 20484 - protein, 1188 aa, ASPERGILLUS NIDULANS FGSC A4
MALHQYDWILALGTIFAFLDAWNIGANDVANSWATSVSSRSVKYWQAMVLATIMEFAGGIGVGATVSDTIRTKVVDVDLFENNPALLMLGMLCALVGSSTYLTFATRIGLPVSTTHSIMGGVIGMGVALVGADGVKWWGGNINSGVVQVFLAWVIAPFISAAFAAIIFLLTKYLILLRSNPARKALYTIPFYFFVTCTLLAMLIVWKGGSSRIKLEGNEIAGTVVGTGAVMAALAAFFLVPWLYRRVILDDWAIRPWHLLLGPLVLRRGEVPPRPEGVKTVQNYYRGHKTFEQIQAERAAGNDVETANKSTPATSTEGSPEIEPKADPRVLASEPDSEPDAINISGPRPEGGNFHPAVLFWQAKRLFFRGIEKDVVSMQNKRNILTGDIEMTHAHADHFENRAEYMFSFLQVLTASTASFAHGANDLSKYGDPYCYSFVSTNATNIWRTASLSGSGGSGKTDVPYWILAFGGASLVIGLWTYGYNIMRNLGNFITLHSPSRGFTMELGSAITIIMATKLKLPVSTTQCITGATVGVGLCNGTYKTINWRMVAWIYMGWIITLPVTGIISGCITGIIINAPRWGYQGLGGMGTVWWGVNRVIISNISQAVYAPIWMPMFSGVAVKCGRVVPKVTELGKAVMIAKDGETRQLPVTLLSGFLGSGKTTLLEHILKSPSHGLRIAVIVNDMSSLNIDAALITHHKVSQTKEKLIQLQNGCICCTLRGDLLAELARLTKQKEVDYVVIESTGISEPMQVAETFTAEFSAAMLEVEGAQDVEGEGNSGASGLDEDDRKVLEEIARIGGLHTLARLDTTVTVIDTFNLLSNFDTAEFLSDRYGSNAIIPEDERTISDLMVDQIEFADVLIMNKIETVDEQTKNKIRRLIGMLNPDAKLIETSYSRVDVKEIIGTGRFDFLKAASGAGWLRSLHEMSVLTTGVGKRVAPRPETLEYVAHIFSLGEYGINNFVYMARRPFHPRRLFSLIHDKFILLQSLNSHDHGDNEEDGEDEEDEKDEEDEYSNANTSESGEEDSDTEITDFSQPDQSLILANKRKSPFGPILRSKGFFWLATRPSHFGEWSQAGSMLTVGCGGPWFAEVPDKAWPEDKDVRGSIERDFQGEWGDRRQELVFIGEGLDVDAVTKLLNGCLLDDKDMARWEKVMRSKKLSMSEKAEKLAEMWEDGWEDWPEVEMEM

SEQ ID NO: 20485 - protein, 169 aa, Triticum aestivum
MAPTVMASSATAVAPFQGLKSTATLPVARRSTTSFAKVSNGGRIRCMQVWPADGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 20486 - protein, 584 aa, Rhodobacter sphaeroides
MTEVMSGARMVVQALKDQGVDTVFGYPGGAVLPIYDEIFQQNDIRHILVRHEQGAVHMAEGYARSTGKPGVVLVTSGPGATNAVTGLVDALMDSIPLVVLSGQVPTFMIGTDGFQEADTVGITRPCTKHNWLVKDTARLAETIHQAFHVATHGRPGPVLVDIPKDVQFATATYQPPQKARVDHYQPKVKGDIEAITRMVELIETAERPVFYTGGGVINSGSAASQLLREFVDATGFPITSTLMGLGAYPASGKGWLGMLGMHGLYEANLAMHGCDLMINVGARFDDRITGRVKDFSPFSQKVHIDIDPSSINKVIRADVPIIGDVGHVLEDALRLWKSRGRKVNREALAEWWKQIAEWKAVNCLDYAPSSKLIKPQHALQRLEALTKGMDRYITTEVGQHQMWAAQFLGFEGPNRWMTSGGLGTMGYGLPASIGVQVAHPEALVINIAGDASFLMNMQEIGTAMQFRLPVKQFILNNERLGMVRQWQQLLHGQRYSQSWSESLPDFVKLAEAFGAKGIQCADPADLDDAIREMIAYDGPVVFDCLVEKHENCFPMIPSGRPHNEMLLGDAETEGAIGAKGAVLV

SEQ ID NO: 20487 - protein, 487 aa, Bacillus subtilis subsp. subtilis str. 168
MKIKAQIGMVMNLDKCIGCHTCSVTCKNTWTNRSGAEYMYFNNVETKPGIGYPKQWEDQDKYKGGWTLKKGKLELKSGSKTNRLAGLFYNPNQPSIDDYYEPWNYDYETLTNSPQKKHQPVARPKSSLTGDFMNIEWGPNWEDDLAGGHITGLEDPNVQKMEESIKTEFDDVFMMYLPRICEHCINPACVSSCPSGAMYKREEDGIVLVDQNACRSWRYCVSSCPYKKVYFNWQTNKAEKCTLCFPRLEAGLPTICSETCVGRIRYLGVMLYDADKVEEAASVENEKDLYHSQLDVFLDPNDPEVAKLAKEQGIPAEWIEAAQQSPIYKMIIDWKIALPLHPEYRTLPMVWYIPPLSPIMNLFEGKGSRQTAEDIFPAIDQMRIPIDYLAQLLTAGDTDHIRSTLKKMSVMRQYMRAVQTNKSIDPELISSVGLTEQQIEDMYRLLAIAKYDDRFVIPSSHREEVSDLYAEQGSCGLSFSGGPGSCF

SEQ ID NO: 20488 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 20489 - protein, 106 aa, Streptococcus mutans
MSRKPIIAGNWKMNKTAAEAREFIDAVKNNIPSNNLVDTVIGSPALFLEGMKKGVKDTELQVAAQNCYWEDFGAFTGETSPAALAALGVDYVIIGHSERRDYFHET

SEQ ID NO: 20490 - protein, 336 aa, Clostridium thermocellum ATCC 27405
MAVKIGINGFGRIGRLVFRASLNNPNVEVVGINDPFIDLEYMQYMLKYDTVHGQFKGEISQDNGKLVVNGRKISVYGFTDPAEIPWSECGAEYIVESTGVFTTTEKASAHFKGGAKKVVISAPSADAPMFVMGVNHDKYTKDMNVVSNASCTTNCLAPLAKVIHENFGIVEGLMTTVHATTATQKTVDGPSKKDWRGGRAAAGNIIPSSTGAAKAVGKVIPELNGKLTGMAFRVPTLDVSVVDLTCRLEKPATYDEIKAAVKKASENELKGILGYTEDAVVSSDFIGDPRTSIFDAEAGISLNSNFVKLVAWYDNEWGYSNKVVDLIVHMASVDAK

SEQ ID NO: 20491 - protein, 623 aa, Glycine max
MFRRSILQISSRPTLKRNPRRFVYQQIPLHLSSQKNFSTVSKPGGASASGSPGKPPESNGTLSKFFIGSVALGAAFLAAYQTHYLDQYLKKEHYSVLQEPHVNATIEDLKSVQHSTDQLISPSEKFNHKNPTVEITEQKIDAHFSHPEIVVEDQVDKPIPVQDKSDIAEDVTAAAKENQLPEYPESSLTSDDPSKESVTQSDGIIGIQSTETVNARMEEGYHHASTSTQTSPDENGMKNIQPEQLEIQETERRESALGKDIEQLPTLLEEYHLRNKSERSPATYISSHGFTENSHFPEGKEALSGAMEELKDGYISENGKLVLDFLQAIHAAEKRQADLDAHAFNEEKKVLKEKYEKKLKDAAARELMLAEEAAMLDRELKRERAKASLAIKSLQEKMEEKLKTELEQKEIETDLKFKQTQELAKAELNAAIANEKAAQIEKMAEANVNRALALEDALSKGLPIETEIASLQSYLGSTDKDSVLDLVLASLPEETRSNGTDTQLQLKQKASCFDALKGSVRHFSFFPPGGGGMLAHSLAHVASWLKVREDNQSGDGIESVINKVEVYLAEGKLAEAAACLEESVRGTQAAEIVAGWVRQARNRAISEQAVLLLQSYANSLSFT

SEQ ID NO: 20492 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 20493 - protein, 386 aa, Zea mays
  unsure (1)..(386): unsure at all Xaa locations
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKXVINNLFVLITTQFISKPLSEGNKHPLLDXSPLPHVQCLCLVMLAVDYRAASEGPLKGIMGYADEDLVSTDFLGDSRSSIFDAKAGIALNDHFVKLVSWYDNEWGYSNRVVDLIRHMFKTQ

SEQ ID NO: 20494 - protein, 314 aa, Methanosarcina mazei Goe1
MKKEWKGEKGAIKPIRALTFGEALFDTIKGTAHLGGAPLNLAAHLAKLGARTAVLTAVGKDELGKILLSRAEEMGVDTSYILIDEKRPTGTVTVELKYEGIPVFSINEGVAWDVITPDEKQFEALAGDEWDVFCFGTLAQRSEENRKTLKRLFQEIKTKHFFYDVNLRAEYYTEEWILSSLEHCTILKMNEEEAEAISGMLFDTIYKFRTLCRLLTDRYPEMSVICITKGPDGAAVYHDGVYEEVSASPIEVADTVGAGDAFSAGFLYAYLSGNGASKALSIATTLGTYVASKPGAVPEYSEELIEELKRYNKT

SEQ ID NO: 20495 - protein, 717 aa, Thermococcus zilligii
  unsure (1)..(717): unsure at all Xaa locations
MADVSHTVENLIRAKLPYPLENLAELAYNYWWSWNRRATRLWEYIDSEHWREYKNPVKLLLDTPEERFWELLKDDDFMNLYELVMDQFTAYMNPKSTWFSTNYPKWDKPIVYLCMEYGISKSLPIYSGGLGILAGDHLKTASXLGLPFIAIGLLYKHGYFRQEIDRDGRQREIFPEYRPEEMPIKPVLSKDGKPLLVEVPIENRIVYARAFEVSVGMAKLYLLDTDVPENSPEDRAICDYLYNAEMDKRIKQEILLGIGGMRLLQALGIEPGVVHLNEGHPAFANLQRIAWYMEKGLTFTEALSIVRGTTVFTTHTPVPAGHDRFPIAEVRKRLSKFLEGREELLELGREGDQINMTLLAIRTSSYVNGVSQLHAEVSKRMWKDLWPGVPLNEIPIEGITNGVHTMTWVHDEMRKLFDRYIGKVWREHTNIEGIWYAVERIPDEELWGAHLEAKRQLIEFLREKTMERNRRLGTDDPIPEIDENALIIGFARRFATYKRATLILSDLERLKKILNNPERPVYIVFGGKAHPRDEAGKEFLRRVYEVSQMPEFRGKIFVLENYDMGSARLMVAGVDVWLNNPRRPLEASGTSGMKAGLNGVLNASIFDGWWVEGYNGKNGWVIGEETTEPESEEDDAKDAESLYTLLEKEIIPTYYGNRSRWIYMMKESIKSIAPRFSTHRMVKEYMDRFYSKAMSNYIWLTRENYKGAREIAAWKER

SEQ ID NO: 20496 - protein, 337 aa, Vibrio vulnificus CMCP6
MTRKHIYIAYTGGTIGMKKSDHGYIPVAGFMEKQLANMPEFHRPEMPQYTIHEYEPLMDSSDMTPEDWQHIANDIRDNYDKYDGFVILHGTDTMAYTASALSFMLENLGKPVIVTGSQIPLAELRSDGQANLLNALHIAANYPINEVTLFFNNQLMRGNRSVKSHADGFNAFTSPNLPPLLEAGINIQISNSIKVGAQPEGEFKVHNITPQPIGVITMYPGISHEVIRNTLLQPVNAMILLTFGVGNAPQNPELLAHLKEASERGVIVVNLTQCLAGKVNMGGYATGCALAEAGVISGYDMTPEAALAKLHYLLSQNLSYEEVKAQMQQVLRGEMSL

SEQ ID NO: 20497 - protein, 416 aa, Listeria monocytogenes EGD-e
MVVADYLALFAVICIWGLLLINIVLIVAGYVYYLKNEARKVPEIPVEVPFVSVMVPAHNEGKVIVKTVESLLAFDYPVDRYEIIVINDNSSDNSAELLAAIQAKNPTRFLKIINTDNITGGKGKSNALNIGFAESRGELVAIYDADNTPERQALRILVGEITNDAKLGAVIGKFRTRNRNASWLTRFINIETLSFQWMAQAGRWALFKLCTIPGTNFIVRRSLLEEIGGWDVKAVAEDTEISFRIYMMGYRIKFQAKAVTWEQEPQTLPVWFKQRSRWAKGNIYVILKNVPLLFKREGRRVRFDILYFLSIYFLLLTSLIVSDVLLVLYALGLVHTTLAGLSGALWLLAILLFVAGTFITLTTEKGEISFSNLLFIMLMYVTYCQLWMVVAAYGFFIFLKDTVLKRETKWYKTERF

SEQ ID NO: 20498 - protein, 492 aa, Raphanus sativus
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLVSKSGKVLFVKFHWKPTCGIKNLTDEEAKVVGGANHSHATKDLHDAISSGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPIPNKSYTGIRTKCIIKKENNFKQAGDRYRSWAPDRQDRFVKRWVEILSEPRLTHEIRSIWISYWSQADASLGQKLASRLNVRPSI

SEQ ID NO: 20499 - protein, 178 aa, Lactobacillus hilgardii
PVVYDPTIADTIENYSHLFLDPQNAAFLSIDDQDDIEASLKNASAGCDIKLIVVTDGEGILGIGDWGVQGVDISVGKLMVYTAAAGVDPKSVLPVVLDVGTNRKELLADDLYMGNHTQRVTGDKYYNFVDKFVETAENLFPDMYLHFEDFGRSNAANILNKYKDNILTFNDDIQGTGI

SEQ ID NO: 20500 - protein, 132 aa, Triticum aestivum
  unsure (1)..(132): unsure at all Xaa locations
MEIAHEARSGIMVRSAPPTPTMWQDSSTDNKRSRGSRAEGRSSGSSADQDPSSPRSKHSATEQRRRTKINDRLDILRDLLPNCDQKRDKXSFLLEVIEYIRXLQEKCQNYDQGFLNKNNVXANCMQWDKVYY

SEQ ID NO: 20501 - protein, 211 aa, Methanothermobacter thermautotrophicus
MAFNIAANDIGNSVGTAVGSGSLRMKKALLLGGFFVLVGALFLGGSVIKTISEGIIPQGLLSPRTALVITLTSSIWITFTIIKKIPISGSDAIVSSVIGAGIASIGIQNMRTDVVGFIVLSWIMSPVAGFLTGFVIYRSIRRVLIKPLQGMGMRDRLEKVFSYLQILSSSFSALNLGAVDIAVATGVIFATGYAGGYWIRILGALGLASGI

SEQ ID NO: 20502 - protein, 198 aa, Yersinia kristensenii
SIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHAFG

SEQ ID NO: 20503 - protein, 114 aa, Klebsiella pneumoniae
MDKQYPVRQWAHGADLVVSQLEAQGVRQVFGIPGAKIDKVFDSLLDSSIRIIPVRHKANAAFMAAAVRRITGKPGVALVTSGPGCSNLITGMATANSKGDPVVALGGAVKLPHK

SEQ ID NO: 20504 - protein, 389 aa, Glycine max; identical to SEQ ID NO: 3946

SEQ ID NO: 20505 - protein, 316 aa, Vibrio vulnificus CMCP6
MSNKLEQLRKLTTVVADTGEIDAIKKYQPEDATTNPSLILKAAQIAEYAPLIDASIEYAKTQSDDKAQQIQDTCDMLAVNIGKEILKTIPGRISTEVDARLSYDMEGSVAKARQLVKMYNDAGITNDRILIKLASTWEGIRAAEILEKEGINCNLTLLFSFAQARACAEAGVFLISPFVGRIMDWYKAKEGRDFEAQEDPGVLSVTKIYNYYKEYGYKTVVMGASFRNIGEILELAGCDRLTIAPALLAELEAAEGEVVEKLVDSKGAAERPAAMTHAEFLWEHNQDPMAVEKLAEGIRNFAVDQGKLEAMIAAKL

SEQ ID NO: 20506 - protein, 365 aa, Oryza sativa
  unsure (1)..(365): unsure at all Xaa locations
AAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQVKNLGNTLFELLSEXALWLKPRYLTDIECNQXQIILCHYYPPCPQPELAIGTSRHSDSGFLTILLQDDIGGLQILHEDRWVDVTPTPGAFIVHVADLLQLISNDNYKSVEHRVVAKNTEPRVSIACFFSTHFHPISTRMYGPIKELLSDENPPLYREALVRDYTARYYSVGLDGKFKTTLSEFRL

SEQ ID NO: 20507 - protein, 319 aa, Treponema denticola
RIGRLVFQALVNQNLLGKDKFDVVAVVDLSTDAKYFAYQLKYDSVQGKMDAKIGTDGDDVLVVNGHKIKCISGKGLTPAQLPWKELGIDVVIESTGIYTNEKAYEHLEAGAKKVIISAPGKSKDPAKPIKTFVMGVNENEYKASEHHVVSNASCTTNCLAPVVHVLLKEGFGIETGLMTTIHAYTATQKTVDGVSLKDWRGGRAAAVNIIPSTTGAAKAVGEVLPTTKGKLTGMSFRVPTPTGSVVDLTIRTEKDTSIEEIDKAIKKASESYLKGVLAYCDEEIVSTDIIHDPHSSIYDSKATLQNNLPGEKRFFKLVS

SEQ ID NO: 20508 - protein, 353 aa, Corynebacterium glutamicum ATCC 13032
MSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGLGHMGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 20509 - protein, 419 aa, Glycine max
  unsure (1)..(419): unsure at all Xaa locations
MEMERVFEFPHTHMDRRPRKRARLGWDIPEVPKAQVGLFCGQDVGTISSFAPSRGPSENTTSSLFVKPVARNGSPPXGEMMTKMGITCLXLGENLTSRYKIHSKMGEGTFGQVLECWDRERKEMVAVKIVRGIKKYREAAMIEXIEVLQQLGKHDKGGNRXSNFNLXLSRMHTTMKILDFIALXNMGSIPILLVNTIKEAIVMHDLRMIHTDLKPENILLVSPEYVKVPDYKSSSRSPSSYFKRVPKSSAIKVIDFGSTTYEREDQNYIVSTRHYRAPEVILGLGWSYPCDIWSVGCILVELCTGEALFQTHENLEHLAMMERVLGSLPQTMMKRVDRHAEKYVRRGRLDWPEGATSRESIKAVMKLPRLQNLVMQHVDHSAGDLIHLLQGLLRYDPSERLTAKEALRHSFFMREHFRR

SEQ ID NO: 20510 - protein, 174 aa, Enterococcus faecium
LYLGNRHARVEGETYYEFIDQFVQSATELFPELLLHWEDFGRGNAAAILEKYEDQITTFNDDIQGTGIVVLAGVLGGLNISGEQLKDQIILTFGAGTAGVGIANILLDEMIRQGVPEEEARQHFYQVDKQGLLFEDTEGLTPGQIPFARKRSEFINADELTNLEAVVKAIHPTI

SEQ ID NO: 20511 - protein, 509 aa, Rhodococcus ruber
MTGTLSRDSGTTNQVDERLGAAAREFLGRPHQLFIDGQWVDAADGRTFGTYDPATGAEITQVAHGGPEDVDRAVAAARRAFDDGDWATMKPNKREQILWRIGDLLDARGEMLGQIEALDNGKSAAIATAVDVTFAADVFRYYAGWCTKIEGTTVDVSMPFAGDKQFHAYTQRVPVGVCGQIIPWNFPLLMAAWKLAPALATGNTLVLKPAEQTPLTALLLGEIMAEAGVPDGVVNIITGFGDAGAAISAHDDVDKVAFTGSTEVGKLIVDAAKGNLKKVSLELGGKSANIVFADCDFDAAVAGSVAAWMFNHGQACTAGTRLYVEDSIYEKFTQAVADAAAQATIGHGLDPATELGPLVDQDQFDKVSYYLRAGIEDGGRALTGGGRHGDTGYFIQPTVFVDVEPDHRVVTDEIFGPVVAALRFSDMDDAVRQANDSIYGLAAGVWTKDISKAHKVASRLHAGSVWVNQYNGFDTAMPFGGFKQSGWGRELGKGALDLYTQTRSVNIQL

SEQ ID NO: 20512 - protein, 334 aa, Shigella flexneri 2a str. 301
MWIKVAAAEQHILVYQYNKEFRMKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKNCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDTLKKDIALGKEFVNK

SEQ ID NO: 20513 - protein, 336 aa, Staphylococcus aureus subsp. aureus MW2
MNREMLYLNRSDIEQAGGNHSQVYVDALTEALTAHAHNDFVQPLKPYLRQDPENGHIADRIIAMPSHIGGEHAISGIKWIGSKHDNPSKRNMERASGVIILNDPETNYPIAVMEASLISSMRTAAVSVIAAKHLAKKGFKDLTIIGCGLIGDKQLQSMLEQFDHIERVFVYDQFSEACARFVDRWQQQRPEINFIATENAKEAVSNGEVVITCTVTDQPYIEYDWLQKGAFISNISIMDVHKEVFIKADKVVVDDWSQCNREKKTINQLVLEGKFSKEALHAELGQLVTGDIPGREDDDEIILLNPMGMAIEDISSAYFIYQQAQQQNIGTTLNLY

SEQ ID NO: 20514 - protein, 355 aa, Streptomyces griseus
MKALVLAGGTGTRLRPITHTSAKQLVPVANKPVLFYGLEAIRAAGIIDVGIVVGDTADEIVAAVGDGSRFGLKVSYIPQSKPLGLAHCVLISRDFLGEDDFIMYLGDNFVVGVVEDSVREFRAARPDAHLMLTRVPEPRSFGVAELSDSGQVLGLEEKPAHPKSDLALVGVYLFSPAIHEAVAAITPSWRGELEITDAVQWLIDAGRDVRSTVISGYWKDTGNVTDMLEVNRLVLETTEPRCDGLVDERSDLIGRVLVEEGAEVRNSRVMGPTVIGAGTRVTNSYVGPFTSLAEDCVVEDSEVEFSIVLRGASISGVRRIEASLIGRHVQVTSAPEVPHANRLVLGDHSRAQISS

SEQ ID NO: 20515 - protein, 604 aa, Rhodobacter sphaeroides
MGVMLLREGHLAPHRIMAALSHGGRPSAPLADLLLAEGALSEDEILAMMARRSGLPVLDPAAERPDPRLIDRLGVRDCLREGLLPLRDTGSAVLLAAAAPESFRRHRPRLEELFGTVIPALASRSSIEDALQELRADAIGAAAELRVAPEESCRDWRTGRMTRLAALAGLALAAGLALAPGLVLLALTAWALLALACGTALRLATAVASLRRPPPEPESPPLLHLPMVSIIVALYREEDIAGRLVARLGRLDYPHDRLEILLVVEEADRRTRRALLEARLPPWMRIVVSPKGAIRTKPRALNVALDHCRGSIVGVYDAEDAPEPDQIRRVVEGFSRRGSHVACLQGRLDYYNPRTNWLSRCFTIEYAAWFRLMLPGLDRLGLVVPLGGTTLFFRRAALEELGAWDAHNVTEDADLGIRLARHGYRTDLIDTVTAEEANCRAIPWIKQRSRWIKGFMMTWAVHMRAPRLLWRQLGPWRFAGFQVMFLGSISQTLLAPVLWSFWLLALGLPHPVAPLVPEPLLWSMIGLLIGSEGTAIAMGILALRQTRHRLNPLWVPTLHLYNPLATFAAYKALWELLRAPFYWDKTCHGVFDAQARGRPLLQPA

SEQ ID NO: 20516 - protein, 266 aa, Vitis vinifera
EKEQPAITTFHGYIPQVPTIDLSDPDEEKLTRLIVEASSEWGMFQIVNHGIPSDVISNLQKVGKEFFELPQEEKELYAKSPDSKSIQGYGSKLQKEVEGKKAWVDHLFHNIWPPPAIDYQFWPKKPPTYRAANEEYAKWLQGVADKLFGRLSLGLGLGEGTLKESVGGDELLYLLKINYYPPCPRPDLALGVVAHTDMSAITILIPNEVQGLQVFRDDHWFDVKYISNALVIHVGDQLEILSNGKYKAVLHRTTVNKEKTRMSWPV

SEQ ID NO: 20517 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 20518 - protein, 500 aa, Triticum aestivum; identical to SEQ ID NO: 1927

SEQ ID NO: 20519 - protein, 473 aa, Zellera tawallina
YESGVIPYAKMGYWDPNYVIKETDILALFRVTPQPGVDPVEASAAVAGESSTATWTVVWTDLLTACDLYRAKAYKVDAVPNVSDQFFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMENMYERAEFAKQLGTVIIMIDLVIGYTAIQTMGIWARQNDMILHLHRAGNSTYSRQKVHGMNFRVICKWMRMAGVDHIHAGTVVGKLEGDPLMIRGFYNTLLLPHLEINLPQGIFFKQDWAALRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 20520 - protein, 454 aa, Hypnea flexicaulis
GYWDPDYVIKETDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIISERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMAIWARKNDMILHLHRAGNSTYSRQKIHGMNFRVICKWMRMSGVDHIHAGTVVGKLEGDPLMIKGFYNTLLLPYLKKNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 20521 - protein, 222 aa, Mesembryanthemum crystallinum
WLVDSKGLIVSSRKNSLQEFKKPWAHEHEPLGDLSSAVKAIKPTVLIGSSGVGRTFTKEVIEAMASFNEKPLIMALSNPTTQSECTAEEAYTWSKGRAIFASGSPFNSVEYEGKTFVPGQSNNAYIFPGFGLGLVISGAIRVHEDMLLAASEALAGQVTQENYDKGMIYPPFSNIRKISAAIAANVAAKAYDLGLATRLPRPENLVKYAENCMYSPVYRSFR

SEQ ID NO: 20522 - protein, 455 aa, Synechocystis sp. WH 8501
MGIATVNPATGETIKIFEPLTAEEIEIKLALAESTFKKYRKISLEQKSQWLNAAADILERDQRKLGEIMTLEMGKPIKSAIAEAKKCALVCRYYAENAANFLKDVPAQTDASRSFIRYQPLGIILAVMPWNFPLWQVFRFAAPALMAGNIGILKHASNVPQCALAVEAILTEAGFPQGSFQTLLIGASQVEAIINDPRVKAATLTGSEPAGASLASAAGKQIKKTVLELGGSDPFIVLESADIEAAATTAVTARMLNNGQSCIAAKRFILAESIADRFQALLTEKFKALTVGDPMQEETDIGPLANASMLLELDQQVQETVTKGGKIVIGGKAIADQPGYFYPPTILTDIPVDSPGYYDEFFGPVALLFRVKDIDEAIELANDTIFGLGASAWSNEPMEQERLIDEIEAGCVFINGMVKSDPRLPFGGIKRSGYGRELSIEGMQEFLNVKTVWIK

SEQ ID NO: 20523 - protein, 254 aa, Brucella melitensis 16M
MTPGIRPLVAGNWKMNGKGESLTELRAIAAGLSSDLGRKLDAVICVPATLLSRAAETLEGETVGLGGQDAHFKTSGAHTGDISPEMLKEAGATHVILGHSERRTDHHESNKLICAKTEAAWAAGLVAIVCVGETASERKAERALDVIGDQLSGSLPDGVTAENTIIAYEPIWAIGTGLTPTVQDVRAAHAFMREQLIERFGAKGAHLRLLYGGSVKPSNAAELLGVADVDGALVGGASLKAADFLAICETYRNL

SEQ ID NO: 20524 - protein, 195 aa, Actinobacillus pleuropneumoniae serovar 1 str. 4074
MAHILFVDNFDSFTYNLVDQFRELGHQVTIFRNDYPLEDFLNKAQTTENCIVALSPGPGIPAEAGNMLAIIKRLKGVVPMIGICLGHQAIIEALGGRIVHTGTVLHGKVSKIEHDNQAMFHGINNPMPVARYHSLMGDNLPEELEINARFDNIVMAIRHKQLPICGFQFHPESILTVEGTKLLKQSVEWLLSTQH

SEQ ID NO: 20525 - protein, 431 aa, Bacillus cereus ATCC 14579
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 20526 - protein, 152 aa, Oryza sativa
  unsure (1)..(152): unsure at all Xaa locations
RSLQXVPIVSIEXRXXXRWEAXXXFSKTQDIQIVADDLTVTNPLRIKKAIDQKAANALLLKVNQIGTLTESIQAAKDSFADGWGVMVSHRSGETEDVTIADIAVGLRAGQIKTGAPARSERLAKLNQILRIEEELGSNAVFAGESFRKAINM

SEQ ID NO: 20527 - protein, 696 aa, Azotobacter vinelandii
MSRTAITCGWWSVTCARSSATIPPIPVSSSPRRASVTACASRPREPPPVFLSGPGRQSLSRSAFMSELALQSNHRPQASSALGLLVAATGVVYGDIGTSPLYTLKEVFAGHYGVRADHDGVLGVLSLIFWSLIWVVSLKYVSFILRADNDGEGGAMALTALARGATAAHPRLSRALVLLGLFGVALFYGDSVITPAISVLSAVEGLELAFAGLEQWVIPLALAVLIALFLIQRHGTARIGTLFGPVMVAWFVVLGLLGLYGILQRPEVLLALNPWWAANFFIVHPGLGVAILGAVVLALTGAEALYADMGHFGRRPIARAWFLLVLPGLVLNYFGQGALLLADPEAARNPFYLLAPGWALLPMIALATLATIIASQAVISGAFSLTRQAIQLGYVPRMQVQHTSSAEEGQVYIGVVNWALMVGVVLLVLGFGSSGALASAYGVAVTGTMLITTLLVAAVMLLLWKMPRWLAVPLLLGFLLVDSLFFAANVPKIFQGGAFPVIAGIGLFILMTTWKRGKETLIERLGESALPLPAFIDSVRLQPPHRVQGTAVFLAARADVVPHALLHNLLHNQVLHERVVLLTVVSEDTPRVPEEKRFQVYSYGEGFYRVALHFGFMEEPDIPDALRLSHLENLDFSPMRTTYFLSRETLIPTRGIGMVYWREALFVFMQKNANSSMRYFQLPANRVIELGTQVEI

SEQ ID NO: 20528 - protein, 389 aa, Escherichia coli
  unsure (1)..(389): unsure at all Xaa locations
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIXXXXXXXXXXXVRAAIEYAFANDRDSVIXVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 20529 - protein, 481 aa, Azotobacter vinelandii
MMLSKERYKAAYVYWLCCIATLGGVMFGFSTGVISGSVELIQQYFHLSPAETGWIVSSIFVGCVLGALAAGKLADRIGRKSTLLLSTLAFAISAYGTTFADSFAIFSSARIVAGIGIGLASTVVPLYMGEIAPRDIRGKASGIWDLSLLGSQTLVFLVNFLIGKGMTEAWLVEVGWRWMMGAQFVPVALMLVCTLILPESPTWCIDTRRVERAIKVLSKIYPDLNHEEARQFFSARETAGGSLGLGVILRTPVLRYGLIVGCAIGVLQQFTGAAIVMYYAPVILQTGDMSKDALLFQTIFIGLFTGIASFVGMTLFDRFGRRPVMKFGTIGSIVGLLLISYSMYTHHSGYLSIFAALFFMAMFGISWSAGCWVLLSEIFPPRIRSHATGLAVTLMWAFNFLVTQFFPMINEIPVLQESFNGAFTMWIFVAFNLFCLFFLIRYLPETRGVALDDMEALIESHRRKLSRKTGETRTSIAVSDI

SEQ ID NO: 20530 - protein, 783 aa, Oryza sativa (japonica cultivar-group); identical to SEQ ID NO: 9347

SEQ ID NO: 20531 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWIEAADLIVKGMEGAINAKTVTYDFERLMEGAKLL

SEQ ID NO: 20532 - protein, 751 aa, Rhodobacter sphaeroides
MTKTKITPEEALLYHLEPRPGKYEITASTPMATQRDLSLAYSPGVAVPVQAIADAPETVYDYTVKGNMVAVISNGTAILGMGNLGAMASKPVMEGKAVLFKRFADVNAIDIELDTEDPDEIIQAVKLMGPTFGGINLEDIKAPECFMIEQRLKELMDIPVFHDDQHGTAVICAAGLINALELSGKKIEDCRIVLNGAGAAGIACLELLKTMGARHDNCIMCDTKGVIWQGRTEGMNQWKSAHAARTELRTLEEAMAGADVFLGVSAKGAVTPEMVRSMADNPVIFAMANPDPEITPEEAQAVRADAIVATGRSDYPNQVNNVLGFPYLFRGALDIHARAINDEMKIACARALAQLAREDVPDEVAMAYGRKLSFGRDYIIPTPFDPRLIYTIPPAVAKAGMDTGVARRPIIDLQGYELALKSRMDPTASILQGIHARAKAAQARMIFAEGDDPRVLRAAVAYQRAGMGKALVVGREQDVREKLEATGLGDAVRELEVVNAANSRHMEAYKSFLYNRLQRGGFDSYDIQRLATRDRHVFSALMLAHGHGDGLVTGATRKSAYVMQLINHVFDAKASDGAVGVTALLHKGRIVLIADTLVHEWPEAEDLADIAIKSARVARNLGLEPRVAFVSFSTFGYPVSERAAKMGEASRVLDGMKVDFEYEGEMTVDVALNKTAMAQYPFCRLTGPANILVVPARHSSSISIKLMQEMAGATVIGPILTGVSKPIQICGVNSTVNDILNMAVMAACKVG

SEQ ID NO: 20533 - protein, 332 aa, Phytophthora infestans
MNVAINGFGRIGRLVLRASAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYDNEWGYSSRVLDLIEHMVKNE

SEQ ID NO: 20534 - protein, 83 aa, Triticum aestivum
  unsure (1)..(83): unsure at all Xaa locations
ILSRYVGFYKGVQSAXAAVAWQVDTHXTSLLSQLIVNWGLCTVSYPLLAVLVLLAVKDEDYSVSNVDGGKEKDAKMAAPSSFH

SEQ ID NO: 20535 - protein, 541 aa, Synechocystis sp. PCC 6803
MTSIDTLWLLLCAGLVFFMQAGFMCLESGLTRSKNSINVAIKNFADFGISVALFWSFGFSIMFGLSQGGWWGTGYSFVDVGGEPTLAVFFLFQAMFCGTATTIISGAAAERLKFSAYLLVAGLASGLIYPLFGDWAWNGLATVAGIETTGGWLENLGFRDFAGSTVVHSVGAWIGLATILVVGPRQGRFPKTGKTLKIQGSNMPFSVLGTLILWFGWLGFNGGSTFGLTPEVPGIMVNTVLAGVGGMLMAGLISLLQDKMIQVEPLMNGSLAGLVAITASANVVMTPIAMVIGATGSAIAYLVGKKMLHWGVDDAVDAVAVHGGAGVWGTLCVGLFGQLPLVDTGLNRWQQCGVQLLGIGVCTLWAFGLAWVFLTLLNRVFALRISPEDEEIGLNVSEHQATTETYELFQVMDRQAKTHDLSLRVPVNPFTEVGHIAGRYNQVMDAFEARHHRSVEDLAQIYYVTAAIAAAIENNSFKADQLGLEEVTNRADELGALARTIQQMAEMLQQRDQELIAVKQQLVLQQQKQHHGNGESVDLSP

SEQ ID NO: 20536 - protein, 324 aa, Triticum aestivum
  unsure (1)..(324): unsure at all Xaa locations
AEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTXDEASHLHFSSSVPLMIGIXLLILQQLSGVKGIFFYAASIFKAAGLKKSNLATCGLGAVHVVATGITTWLTDKAGRRLLLIISATGMTISLLVVSVSFFVKDNIDEASHLHFVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 20537 - protein, 215 aa, Zea mays; identical to SEQ ID NO: 2377

SEQ ID NO: 20538 - protein, 700 aa, Glycine max
  unsure (1)..(700): unsure at all Xaa locations
MAVIMALNGYYYNNIKLGNQRRAPHNLSFPGSISVHKLPKNRRSKSYKSGNDKFPRFLVEMRQTELPPSKYGTNGRAVKMVPANEVVKRKTMSENKVEMARGSKQAVNGASLVERDPSLALTKTKKSTTSKELPPLEELKVLPSDEGFSWANENYNSLQRSIDVWXFGISLRLREDDXKGTEAKQKSRRRKTASWLRKCVLQLGPTFIKLGQLSSTRSDLFPREFVDELAKLQDMVPAFSPKKARKFIESELGAPINILFEEFEDRPIAAASLGQVHRAILHNGEKVVIKVQRPGLKKLFDIDLKNLKLIAEYFQRSETFGGPLRDWIGIYEECKTILYQEIDYINEGKNADRFRRDFRNIKWVRIPLVYWDYTALKVLTMEYVPGIKIDQVDTLTSRGYDRLRISSRATEAYLIQILKTGFFHADPHPGNLAIDVDEAIIYYDFGMMGEIKSFTRERLLELFYAIYEKDAKKVMQRLIDLGALQPTGDLSSVRRSMQFFLDHLLSQTPDQQQTLSAIGEDLFAIAQDQPFRFPSTFTFVIRAFSTLEGLGYILNPDFSFVKIAAPYAQELLDIRQKRPTGPQLVEEIRKQADDARTNSISMPYRVQRIEEFVKQLEAGDLKLRVRVLESERAARKATILQMATMYSVLGGTLLNLGVTLSSQGNQAFANGSFIGAGILGALFLRSMQRVKKLDKFENMI

SEQ ID NO: 20539 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGIDGVKNKIDPGEAMDINLFKLTLDEIREKGIKQMPHTLRRSLEEMLADKQYLKEGQ

SEQ ID NO: 20540 - protein, 343 aa, Physcomitrella patens
MASEGVLLGMGNPLLDISCVVDDAFLEKYGLTLNNAILAEDKHLPMYKELAANPDVEYIAGGATQNTIRIAQWMLGESNATSYFGCVGKDEYGDRMFKLASEGGVNIRYDVDEDLPTGTCGVLVVKGERSLVANLSAANKYKIDHLKKPENWAFVEKAKYIYSAGFFLTVSPESMMTVAKHAAETGKYYMINLAAPFICQFFKDPLMELFPYVDFIFGNESEARAFAQVQGWETEDTKVIAVKLAALPKAGGTHKRVAVITQGTDPTIVAEDGKVTEFPVTPIPKEKLVDTNAAGDSFVGGFLSQLVLGKDIAQCVRAGNYAASVIIQRSGCTFPSKPSFESQ

SEQ ID NO: 20541 - protein, 165 aa, Triticum urartu
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHYSSPGYYDGRYWTMWKLPMFGCTDATQVLNEVEEVKKEYPDAYVRVIGFDNLRQVQCVSFIAFRPPGCE

SEQ ID NO: 20542 - protein, 501 aa, Oryza sativa
MERVAAAKKFIENHYRSQMKNIQERKERRFRLERQLESSQVPREQQINLLKDLERKETEYMRLKRHKICVDDFELLTIIGRGAFGEVRLCREKTSSNIYAMKKLKKSDMVVRGQVEHVRAERNLLAEVASHCIVKLYYSFQDSEYLYLIMEYLPGGDIMTLLMREDTLTEHVARFYIAETILAIESIHKHNYIHRDIKPDNLLLDKNGHMKLSDFGLCKPIDCSKLSTLNEDEPMGDDNLRESMDIDSSFSETTNGRRWRSQHEQLQHWQMNRRKLAFSTVGTPDYIAPEVLLKKGYGMECDWWSLGAIMYEMLVGYPPFYSDDPITTCRKIVHWRNHLKFPEDSKVSPEARDLICRLLCDVDHRIGSAGADQIKAHPWFRGVAWEKLYEMEAAFKPQVNDELDTQNFMKFEEMDNAPTRTGSGPSRKMMLNSKDLSFVGYTYKNFDAVKGLKHSDQQRNQSLIRPSIGSIFGPADMDPSREPNGRDKHMHTVSSGDPMIQ

SEQ ID NO: 20543 - protein, 773 aa, GIBBERELLA ZEAE PH-1
MKLSAYVCAAVLATAGQAAKDKPVYKDAKASVDDRVSDLLKRMTIQDKAAQLIQGDMTNYLNLTTEAVNKTGLEWNFKYRANSIWTGLYANMTTIKKAAKVGQDYLMKETELGIPAFIQSEGLHGVLILNGTIFNSPIGMGCSFNPELIEKMADIIATESRAVGINQLFSPQVDLARELRFGRVEECFSEDPYLAGEMGYSYVKGLQAGGVSAMVKHYAAFATPEQGINTAPVHGGERELRSLYLPPFKRAIIDGGATSIMSSYNSYDGVPVVSDSHLLTDILRDEWDYKYYVISDAGGTARLAQAFHVCPLEDDECITLEALPAGNDAEMGGGYWSFEIIPELVKAGKLDEKIVDTAVSRVLRSKFEMGLFEKPFTGVADDKIWDYVNTKAHKKVARQLDAESIVLLENHENVLPLKKDANIAVIGPMAHGYVNVNNYGDYVIHTAMTRGVTPYDGIKAASKGKVTFTQGCERWSSDESKFEDAVAAAEAADVAVVVVGTWTRDQNELWGGLNATTGEHIDASNLNLIGAMPKLVKAIIDTGKPTVVVYSSGKPITEPWISKEAAALVQQFYQSQEGGHALADILYGNVNPSGKLSVSFPYDVGTTPIYYDYLNSARASPNPGKIYENGTLEFGSNYILENPEALYTFGYGLSYSKFDFSKISVSKKNVTSSDTVTVSVNVSNKSKRDGSEVVQLYVKDMLSSVDVPRYQLKGFKKVAVKAGKTETVKIDLKVEEWGLWNRKMKYVVEPGDFTVFVGNSSENFMGNVTVTVA

SEQ ID NO: 20544 - protein, 263 aa, Triticum aestivum
  unsure (1)..(263): unsure at all Xaa locations
MGRSPCCEKEHTNKGAWTKEEDQRLIAYIRVNGEGCWRSLPKAAGLLRCGKSCRLRWMNYLRPDLKRGNFTDEEDELIIRLHSLLGNKWSLIAGQLPGRTDNEIKNYWNTHIKRKLTSRGIDPVTHRAINSDHAASNITISFEAAQRDDKGAVFRRDAEPTKVAAAAAAITHVDHHHRSNPHHQMEWGQGKPLKCPDLNLDLCISPPSHEDPMVDTKPVVKREAVVGLCFSCSMGLPRSADLQCSSFMGLRTXMLDFRSIEMK

SEQ ID NO: 20545 - protein, 485 aa, Magnetospirillum magnetotacticum
MIKHLINGKHVESASTIANLNPATNEVICQIAAGGEAEVARAVAAAKEAFPKWAGLAPAQRAKLLRKVGDLINQHVDEIAKLESLDTGQSYWRTKKMLVPRAADNFYFFADTCQHVDGETYPTNDHLNYTIYQPVGVVGLISPWNVPFMTATWKTAPCLAFGNTAVLKMSELSPLSADRLGQLILEAGIPAGVFNIVHGYGSAVGEALVKHPDVRGVSFTGSTATGNRIIQSGGLKKYSMELGGKSPNIVFDDCDFERAVDAAIVAVYGNNGESCTNGTRILVQDGIYDRFVAALAERTKKVVVGDPLDEATNVGPMITRDHWKKVTGYIELGIKEGARVVAGGLGEPEGLPAHLKNGNFVKPTVLADVDNSWRVAQEEIFGPVACVIRFKDEAEALKIANATTYGLASYVWTENGAKAIRMAEGIEAGLVFVNSQNVRDLRQPFGGIKGSGTGREGGHYSYEAFLEVKNVCVSKGNHHIPRWGV

SEQ ID NO: 20546 - protein, 216 aa, Magnetospirillum magnetotacticum
MQIMPDGPNDHLSFDPLDDTKRWPEDQFPLLKCGRMVLDRVPDNFFAEVEQSAFGTGVLVDGIDFSDDKMLQGRTLSYSDTQRYRVGANYLQLPINAPQPGVKVYSNQRDGQMTYGVDGTGPNKHINYEPSTLGQGLAEAPKKKEYHQPVSGNLGRYQTSRTEDDYAQAGHRYRTFEDWEREDLIANLVADMKQCPEPIQLRMVWHFWHADEDYGR

SEQ ID NO: 20547 - protein, 298 aa, Streptomyces antibioticus
MDLTGRRAVVTGGASGLGAETVRALAAAGAEVTVATRRPLSAEPLVQELAAAGGAGRVTAEALDLSDPASVESFARAWRGPLDILVANAGIMALPTRTLAPNGWEMQLATNYLGHFALATGLHAALRDAGSARIVVVSSGAHLDAPFDFEDAHFARRPYDPWVAYGQSKAADVLFTVGARRWAADGITVNALNPGYILTRLQRHVDDETMRAFGVMDDQGNVKPLPYYKTPEQGAATSVLLAASPLLKGVTGRYFEDNQEARTVQGQEDQPGGVAAHALDPEAADRLWEYGTDALRAA

SEQ ID NO: 20548 - protein, 764 aa, Methanosarcina mazei Goe1
MTEGDKSTIKLKVAEADQRDVGKGIVRIDEKFREKLGLKPFDVVEIRGGKSTSALIGRPYPSDSGLDIVRMDGLIRMNAKTSIGEYVDIRKADWKEAKSVTLAPVAKGMQIYAPSETLKAVFMNRTVSKGDFISTTSLRRSRERETFGKGVMFEDFFQDFFGQGFGQSFGLGEIKLQVVSTSPSGIVKITDMTQVELLPEATEITPEQNIPTVMYEDLGGLKDAIGRVREMIELPLKHPELFDRLGIDAPKGVLLHGPPGTGKTMLAKAVANESDAYFISINGPEIMSKYYGESERAIREIFEDAEKNAPAIIFLDEIDSIAPKRAEVTGEVERRVVAQLLSLMDGLKARKNVIVIGSTNRPEAIDIALRRPGRFDREIELRVPDTEGRLEIFQIHTRGMPLADNVNLMDFAQITYGFVGADIAALCREAAMSALRRILPKINLNEPEIPGEILDSLQVTREDFENALKDVQPSAIREILIEVPNIGWDDVGGLGEVKELLKEAVEWPLKSPESYRNIGVEAPKGVLLYGPPGTGKTLLAKAIAHESDANFITAKGSDLLSKWYGESEKRIAEVFTRARQVAPSIIFLDELDSLAPVRGASTGEPQVTARILNQLLSEMDGLEELRAVVVIGATNRPDMIDPALLRPGRFDELILVPVPDEGARREIFRVHTENMALAEDVDIEKLVSLTDQYTGADIAAVCKKAGRYALREDLHAKSVRQKHFLQAIEETGPSVTPDTMKYYQAIRGELRKRKSKEIESPYYI

SEQ ID NO: 20549 - protein, 485 aa, Neurospora crassa
MGLRPPKIRDSGLFGIKFIKTNVKMAAEHKNLQFWQQMFRSIGGYTGEVRLVGHRIIFTSEPENMKAILATQFEDYGKGEGFHQEWKDFLGDSIFTTDGDLWHASRQLIRPQFIKNRVSDLQCFENHMQMLFRTIANGGALNGEDQMVDMEAGNGKPVDISDLFFRYTLDAATDFLLGKDIKSLSTPVQPFADAFQEVQRVQIVIARAGPLNRFVPKKTFWEGLKVIDETINFYIDRALRLDEEELASKSKGDEGYTFLHALAGFTKNRQVLHDQLMAVLLAGRDTTACTLSWAIYELARHPEAVAKLRAEILSVVGPDRAPTYDDLKSMKYLQNVMNETLRLVRMALKDTTLPRGGGPDGSQPIVILKDTPVGYSPLAMQRRPDLYPPVSEKFPDVEMFSPDRWFHWQPKPWQYIPFNGGPRICIGQQFALTEMGYVLTRLFQRYDRVVSYMDEIDGGKPRMKTDIVLMPGDGVKVAFFEAKRE

SEQ ID NO: 20550 - protein, 382 aa, Arabidopsis thaliana
MGNSSEEPKPPTKSDKPSSPPVDQTNVHVYPDWAAMQAYYGPRVAMPPYYNSAMAASGHPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 20551 - protein, 525 aa, Streptomyces coelicolor A3(2)
MTSVVGDRLRLVVRVLGSLVADEVGQATRLRRRTKRDTRSPAEGLVGSAGSAAEATAGAEQRRAKAVRHALESLGPFYVKLGQVLSTRPDMVPQSIRDELQNLHDEVDVQPFSEFEPVLARDLGADWKLRFDDIETVAPLGAASLAQVYRVTLPGGRAAVVKIQRPGIREGVLADMALMRRASKIVARVAPRFNEVIDIEAMLGSVFDAMEPELDFTGEARNMDEARGQVRSFRSLEVPRVLHASPRVLVQSLADGKSVRHVDRAHFTDDERVEIGKDLLRFMYHGYFVHRFFHADPHAGNVFAAPGGPATLIDWGMVGRLDRRTSLQLLPLFMTLAQNDGAGLAQHWAEMGRVTPWANMPAFAADMAAFVPKVSHLSLEDMNFGVALTTVLAKATKRGIGSPPAVSLLGKSFANLDGSVRCLAPEITLPEVFQGEVPKILFALGREFLGRNQFARNSMELLLAAVTSPEQVRGVLSDVANRQFALNIHEPRTPDAMGGQRPTRPSASLLALGAAAFLLGRRRSG

SEQ ID NO: 20552 - protein, 95 aa, Nicotiana tabacum
MRGVLVDWLVEVAEEYKLLSDTLYLAVSYIDRFLSTKVIPRQKLQLLGVSSMLIASKYEEINPPHVEDFCYITDNTYTKEDVVKMEADVLQSLKF

SEQ ID NO: 20553 - protein, 433 aa, Picea abies
MEHLNTAAAQASSSLYGVGMAEYGDAGVSSMMALITQHEPHDSESIMSTRMPSSFSSFHGHADCLLSAAMFQASQGDHKLKRQPGMDQLVSEQAGMSDSSMPSVKTEVGSGLRNQLEFHREQTGNGYTDQSSNTPVNPLVTSLASQARGEAQMIPSWDANSPHFNVDNEEYAIKSKILAHPQYPSLLGAYIDCQKIGAPPEAVARLDALTREYQNQQRRTVSIGMDPELDQFMEAYCEILTKYHEELAKPFKEAMTFLMKIEAQFNSLGKGTIRISPPAENDKKTEGGGSSEEVEDGSGGETDFQEVDHHAVEDRELKDHLLRRYSGYLSSLKQEFMKKKKKGKLPKDARQKLLDWWSLHDKWSYPSETEKIALAECTGLDQKQINNWFINQRKRHWKPSEDMHFMVMNSHSPHSAALYVERHLMTEGYHLDC

SEQ ID NO: 20554 - protein, 109 aa, Glycine max
  unsure (1)..(109): unsure at all Xaa locations
TLDSCGSTPXXTGDGEGGSGFAAGSVSGFEFGVDPNLDPELALALRVSMEEERARQEAAAXXAAEDAAKQEKDGEQQASPQDTTMTKGVSAAASEAETKNDSCTDYDEL

SEQ ID NO: 20555 - protein, 296 aa, Salmonella typhimurium
MSFFHANQREALNQSLAEVQGQINVSFEFFPPRTSEMEQTLWNSIDRLSSLKPKFVSVTYGANSGERDRTHSVIKGIKERTGLEAAPHLTCIDPTRDELRTIARDYWNNGIRHIVALRGDLPPGSGKPEMYAADLVGLLKEVADFDISVAAYPEVHPEAKSAQADLLNLKRKVDAGANRAITQFFFDVESYLRFRDRCVSAGIDVEIIPGILPVSNFKQAKKFADMTNVRIPSWMSLMFEGLDNDAETRKLVGANIAMDMVKILSREGVKDFHFYTLNRAEMSYAICHTLGVRPGL

SEQ ID NO: 20556 - protein, 510 aa, Rhodospirillum rubrum
MPFPRADSQRTRMISPSGPKNMKKLHKELKRFSAIEAGLAITGRPAVGIGLAVVFLGVIWAFTAMTFGQTPSHTFLVLAAVVGGYMALNIGANDVANNMGPAVGSRAMTMAGALLIAAICEASGAILAGGDVVETISKGIIDPGAMSDNVKFVQVMIAALLASALWVNLATYLNAPVSTTHAIVGGVMGAGALAAGVGAVHWSTVGAIVASWVISPMMGGVIAAALLLFVKKMILFQDDKIAAARRWIPVLIGLMAGAFGMYLLTKGLARVYAPPSWLVGLAGVGSFLGVWALMRPIVRRQTVEMENRRKAVSGLFTHALIFSSALLSFAHGANDVANAVGPLAAIANALAGGGVEDQAVVLPLWILVVGAAGISAGLFLFGPKLIRTVGEKITKLDRARAFCVSLSAAVTVLAASGLGLPVSSTHIAVGAVFGVGFLREALANHQELSHLVHPPRLDAIDNPQRVEKLERRRLVRRQHITTIGAAWVVTVPLSAALSAGLYLLLTAFLE

SEQ ID NO: 20557 - protein, 337 aa, Petunia x hybrida
MAKIKIGINGFGRIGRLVARVALQRDDVELVAVNDPFISVEYMTYMFKYDSVHGQWKHHELKAKDDKTLLFGEKPVTVFGIRNPEEIPWGEAGADYVVESTGVFTDKDKAAAHLKGGAKKVIISAPSKDAPMFVVGVNEKEYKSDLTVVSNASCTTNCLAPLAKVINDRFGIVEGLMTTVHSMTATQKTVDGPSAKDWRGGRAASFNIIPSSTGAAKAVGKVLPALNGKLTGMAFRVPTVDVSVVDLTVRLEKEATYDEIKAAIKEESEGKLKGIPGHTEDDVVSTDFIGDNRSSIFDAKAGIALSKNFVKLVSWYDNEMGYSTRVVDLIKHIASVE

SEQ ID NO: 20558 - protein, 511 aa, ASPERGILLUS NIDULANS FGSC A4
MADLFVDLVAPNGTHYSQPTGLFINNAFVASSGQTITSLDPATDKPIATVHAASAEDVDRAVIAARAALVHPSWKKLPGTERGQLMARLADLMEKNKELFATIDAWDNVLSLTEKSGKPYHIALSEDLVEAIGTIRYYSGWADKTFGQTISTTPAKFAYTIRQPVGVVGQIIPWNYPLSMACWKLGPALACGNTVVLKPAEQTPLSVLVLGSLIKEAGFPPGVVNIVNGYGREAGAALAGHPLIDKIAFTGSTVTAREIMKLAAGTLKNITLETGGKSPLLVFPDADLEQAVKWSHFGIMSNQGQICTATSRIYVHQDIFQLFLSKFKAAVETTSKIGDQWDESTFQGPQITRAQYDRILSYIETAKKGGMAVVTGGSAHAPSSEKNKDGYFIQPTVFTGTDDSHAIVREEVFGPVVVILPFASEEEAIRRANDTTYGLGAAVFTCDLERAHRVAAEIEAGMVWVNSSQDCDPRVPFGGVKQSGIGRELGEAGLEAYTQVKAVHVNMGNKL

SEQ ID NO: 20559 - protein, 282 aa, Neurospora crassa
MTSDKPVVAATTTKTKKSKQQTIHYPFWFGGSASSMAATVTHPLDLVKVRLQMRTGDAPKTMSGTVLHIIRHNGITGLYNGLSASLLRQITYSTTRFGIYEELKTRFTTKDHPASFPVLIAMATVSGVAGGLVGNVADVLNVRMQHDAALPPAQRRNYAHAIDGLARMTREEGFRSWFRGVWPNSARAAAMTASQLASYDVFKRILIRHTPLEDNLATHFSASFLAGVAAATVTSPIDVVKTRVMSASGKSSIGQVLGSLYAQEGVRWMFKGWVPSFLRLGP

SEQ ID NO: 20560 - protein, 509 aa, Sesamum indicum
MALPLLILSFLTIFIAYKLFQRLRYKLPPGPRPLPVVGNLYDIKPLLVRCFTEWSQVYGPIFSVYLGSHLSVVVNSAELAKEVLKDNDQQLANRNRTRQIAKFSKNGADLIWSDYGPHYVKVRKLCTLELFSMKRLEGLRPIREDEVTAMVESIFKDCNKPENKGKALVLREYLGMMAFLHIARLTFGKRFMDSNGVVDGQGEELKAILHNGIKLGTKKSWAEFLPWFRFLFKTENQLLAEHDALADSFTKKIMQEHTLARQKTGNTKNHFVDALLTLQKEYDLSDDTVIGLLWDMISAGMVTTTITVEWAMAELVRNPRVQQKVQEELDRVVGSDRVMTEADIPNLPYLQCVTKECFRMHPPTPLMLPHKASTNVKIGGYDIPKGATVSVNVWALARDPAVWKNPLEFRPERFQEEDIDMKGTDYRLLPFGSGRRICPGAQLAIYLVTSMLGHMLHHFTWTPPAGTKPEDMDMMEQPGTVTYMRTPLQAVPTPRLPADLFKRVASGNV

SEQ ID NO: 20561 - protein, 289 aa, Pyrobaculum aerophilum str. IM2
MLLLPNIDFIVEPAEAVETIKAAYFAEAKFLPRQALTVGDTWFAPMVGYLPGAGIAVKLVGIYPKATPRVKAVVIVFDKDMGTPLALINGTQLTAWRTAAASGVVAKTLGVNPGEVGIIGAGVQGEYHLRVFKALYPGAKYKIYNRDSKKAEDLGKRYGAIPSSLGDVLKSDLIIAATASTSPVVRGAELKNGAVVISIGAPRPVRELDDDVKKRAGCMLVDNPHAVDETDDIGQNWVYVGDFLKGASCNFGEIAVYKSVGNPLFDAAFANYVLEKAKKLGVAVEIKWD

SEQ ID NO: 20562 - protein, 377 aa, Glycine max
  unsure (1)..(377): unsure at all Xaa locations
LAYVSRESRVVGAGDLVDHPKRIALHYLKGYFLIDLFVVFPLPQIMILXVLPNSLEGANYAKNLLRAAILVQYIPKLFRFLPLLIGQSPTGFIFESAWANFIINLLIFMLASHVVGSCWYLFGFQRVNQCLRDACHSSNIPGCMKFIDCGRGHGKNQPSLRSDQWINNTDAVACLDPSPDGFSYGIYENAVPLTIETNIVNKYVYSLFWGFQQISTLAGNLEPSYFVWEVLFTMAIIGMGLLLFAILIGNIQNFLQALGRRKLEMQLRGRDVEQWMSHRRLPEDLRRRVRQAERYNWAATRGVNEEMLMENLPEDLQRDIRRHLFKFVKKIRLFALMDEPILDAICDRLRQKTYIKGSKILSQGGLVEFLLLMFLQN

SEQ ID NO: 20563 - protein, 136 aa, Zea mays
ETGSSGSIVAAVLFYLLSFVGVLPGERLVLLGPAAGERLVLPGPLKRSHGIGGLCRLLPALQMSVQDANMSSDTDMSKVFEDRTFVSSILNSLPGVDPNDPSIKDLLASLHSQGEEEKKEDKSDKTEDEKNCFKLE

SEQ ID NO: 20564 - protein, 711 aa, Streptococcus pyogenes M1 GAS
MRELHIKTYKLLTKSAVLLGLISFPLTVSAADNASVTNKADFSTDTIYQIVTDRFNDGNTSNNGKTDVFDKNDLKKYHGGDWQGIIAKIKDGYLTDMGISAIWISSPVENIDSIDPSNGSAAYHGYWAKDFFKTNQHFGTEADFQQLVKVAHQHHIKVVIDFAPNHTSTAEKEGTTFKEDGALYKNGKLVGKFSDDKDKIFNHESWTDFSTYENSIYHSMYGLADLNNINPKVDQYMKEAIDKWLDLGVDGIRVDAVKHMSQGWQKNWLSHIYEKHNVFVFGEWFSGHTDDDYDMTTFANNSGMGLLDFRFANAIRQLYTGFSTFTMRDFYKVLENRDQVTNEVTDQVTFIDNHDMERFATKVANNQTAVNQAYALLLTSRGVPNIYYGTEQYATGDKDPNNRGDMPSFNKESQAYKVISKLAPLRKQNQALAYGTTEQRWISDHVLVFERKFGNHVALVAINRDQTNGYTITNAKTALPQNSYKDKLEGLLGGQELIVGADGTISSFELGAGQVAVWTYEGEDKTPQLGDVDASVGIAGNKITISGQGFGNSKGQVTFGEISAEILSWSDTLITLKVPTVPANYYNISVTTADKQTSNSYQAFEVLTDKQIPVRLLINDFKTVPGEQLYLMGDVFEMGANDAKNAVGPLFNNTQTIAKYPNWFFDTHLPINKEIAVKLVKKDSIGNVLWTSPETYSIKTGHEAQTITIKK

SEQ ID NO: 20565 - protein, 416 aa, Escherichia coli K12
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 20566 - protein, 250 aa, Arabidopsis thaliana
MSRRYDSRTTIFSPEGRLYQVEYAMEAIGNAGSAIGILSKDGVVLIGEKKVTSKLLQTSTSAEKMYKIDDHVACAVAGIMSDANILINTARVQAQRYTFMYQEPMPVEQLVQSLCDTKQGYTQFGGLRPFGVSFLFAGWDKHHGFQLYMSDPSGNYGGWKAAAVGANNQAAQSILKQDYKDDATREEAVELALKVLTKTMDSTSLTSEKLELAEVYLTPSKTVKYHVHSPESLTKLLVKHGVTQPAAETS

SEQ ID NO: 20567 - protein, 827 aa, Candida albicans
MSKSRTVTGSLDQKIYNLIHDLLQEQTEENKRAATADEEHDPFSCMASSHNLTVSQVLAYVQMKDFQLKRMKKNYLEKSIAASLKVIRQDETEEFGDRENGIGDESEAENDKECENDLMEVKDSNAINKSVVSLWNQEKTDGESDGVNNEEGQQADTTELLKGNKRKAKGSAKTQLKKQKRKIDYSTPNIDLSSLGGVESVTTQLLEIIGLPILHPEIYSSTGVEPPRGVLLYGPPGCGKTTIANALAGELKVPFINISAPSVVSGMSGESEKKLREIFEEAKQIAPCLIFMDEIDAITPKRDGGAQREMEKRIVAQLLTLMDELTLEKTGGKPVVVIGATNRPDSLDSALRRAGRFDREICLNVPNEEQRISILKAMTKNIKLENGEHFNYRELSKLTPGYVGADLKSLVTAAGISAIKRIFETMSELQEESHSVKDDSMDADPVSLDANKEDMIKKFEQKSEAEKLSTIKKFLNMHPDPLNQEQLAPLAITYQDFVNALPSVQPSAKREGFATIPDVTWQNVGALFKIRMELHMCIVQPIKKPELYLKVGIAAPAGVLMWGPPGCGKTLLAKAVANESRANFISIKGPELLNKYVGESEKAVRQVFQRARASTPCIIFFDELDALVPRRDTSMSESSSRVVNTLLTELDGLNDRKGVFVIGATNRPDMIDPAMLRPGRLDKTLYIELPTPEERLEILKTLVRTSNSPLHANVDLNAISRDSRCGNFSGADLSSLVKEAGVWALKKRFFQNQKIQELDSSGFYEDSIGEDDISITAEDFDHALSSIRPSVSDRDRMRYEKLNKKLGWNIISDKEPDDAGSTSDKND

SEQ ID NO: 20568 - protein, 298 aa, Synechocystis sp. WH 8501
MIFIWLYPQSLFDVQVKRIHEYKRQHLNVLHIITLYKCLKNDPNLDVPPRTFIFGGKAAPGYFMVKRMIKLITAVGDVVNNDGDIGDRLKVIFLPDYNVTFGQRVYPAADLSEQISTAGKEASGTGNIKFSMNSALTIGTLDRANVEICEEVGAENFFLFGLTNPEVLNLKAQGYVPRRYYASIPELRGVLDLISSGFFSHGDPELFQCVVDNLLYDDPYLLLADYQSYIECQDKVSQAYKDQENWSNMSILNVARMGKFSSDRSIKDYCGKIWNAPPVPIKLKDYVQKEAQLRVNKF

SEQ ID NO: 20569 - protein, 681 aa, Oryza sativa
MALVCAECRLVDIVRVHANLMVPEMEIQLGEEVGVAKFIKQFVENQNGKHVLGSHRVEGSVVHVEAPWLVDQQNRRREWRRVGADGELVSALFLQFVVLKLWVAIRSNHYRGLAGLEVDVMIDGSGRWEAGWSAKRSSNSASKDGRRSSACSAAQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 20570 - protein, 387 aa, Glycine max
  unsure (1)..(387): unsure at all Xaa locations
MASDGFTDKNTVFRKLKAKSENKMCFDCNAKNPTWASVTYGIFLCIDCSAVHRSLGVHISFVRSTNLDSWSPEQLKTMSFGGNNRAHGFFKQHGWTDGGKIEAKYTSRAADLYRQILSKEVAKSMAEDGGLPSSPVASRPRTRGSGXPEKPESTSSPRASHSVISGTVKKPIGAKKAVKSGGLGARKLTKKPSESLYEQKPEEPPAPVPSSTNSMPAGPSPTSRFEYVENVQSSDLNTGGSHVLSHVSPPKSSSFFADFGMDGGFPKKSGPSSSKVQIQETDEARRKFSNAKSISSSQFFGDQNKAADVDSQATLSKFSGSSAISSADLFGDSRDNNIDLTAGDLINRLSFQAQQDLSSLKNIAGETGKKLSSLASTLMTDLQDRIL

SEQ ID NO: 20571 - protein, 49 aa, Triticum aestivum
FGRGELKALWDSQVNDEEQWALNYKLLKAAGLFAGSIFLMRNFGDLMAI

SEQ ID NO: 20572 - protein, 412 aa, Medicago sativa subsp. X varia
MTELDPSKKVADRYLKREVLGEGTYGVVYKAIDTQTGQTVAIKKIRIGKQKEGVNFTALREIKLLKELKDPNIIELIDCFPHKGNLHLVFEFMETDLEAVIRDRNIFLAPGDIKSYLQMTLKGLAHCHKKWILHRDMKPNNLLIGPNGQLKLADFGLARIFGSPDRRFTHQVFARWYRAPELLFGTKQYGPGVDVWAAACIFAELLLRRPFLQGSSDIDQLGKIFAAFGTPSPSQWPDMVYLPDYVEYQFVPAPPLRSLFPMATDDALDLLSKMFTYDPKDRISVQQALEHRYFTCPPQPTDPVKLPRPAPKKEIKPSDLNPPEGPTVLSPPRKTRRVMPGRDGLEGNSLQGDRVDDNHGNLKQTGGDNTGKNEPAPMSLDFSVFGLKPPNRPTINSADRSHLKRKLDLEFQ

SEQ ID NO: 20573 - protein, 474 aa, Pseudomonas putida KT2440
MQTKLLINGALVAGEGDHVDVYNPSLGRVLVQTHEASHAQVHAAVQSADAAFEAWSQTPPKDRAALLLTLADRIDAQAAVFARLEADNCGKPFTAVLQDELPAVSDVFRFFAGAVRCLQGSAAGEYIPGHTSMIRRDAVGVVASIAPWNYPLLMAAWKLGPALAGGNTVVLKPSEHTPMSTLKLGELLADIFPAGVVNIVHGRGATVGEPLTSHALVRMVSLTGSVRTGSRIIEGTADSVKRMHMELGGKAPVLIFDDADIDAAVEGIRAFGFYNAGQDCTAACRLYVQKAVYPEFVRKLGEAVSSIKCGLQDDPATEMGPLITQEHLQRVEGFVNRAREQPHIEVVTGGKRAAGAGFFFEPTVLAGTRQEDEVVCREIFGPVVTVSPFEDEAQVLAWANESDYGLASSVWTADVGRAHRLAARLQYGCTWVNTHFMLVSEMPHGGVKLSGYGKDLSMYGLEDYTLVRHVMFKH

SEQ ID NO: 20574 - protein, 241 aa, Desulfitobacterium hafniense
KLTVLRRPRKDFAWSVPISTQCLHAAGAALAFKLRKEQNLAVACCGDGGSSKTDFYAALNSAGAYQLPLILCVINNGWAISVPRKAQTGAKTLAQKGLAGGLHCLQVDGNDLIAVLEGMRRAAELARSGEGGSVIEFMTYRLHDHTTADDARRYRDDAEVKDAWTRDPVPRLRTYLTDQGVWNDELEKAWIEECGKKVDVEINAYLETPVQPVEAMFDFLYADMPADLAAQREQALQENRR

SEQ ID NO: 20575 - protein, 393 aa, Streptococcus mutans UA159
MAEKVSFEEGKLQVPDKPVIPYIEGDGVGQDIWKNAQIVFDKAIAKVYGGHKQVIWREVLAGKKAYNETGNWLPNETLEIIKTHLLAIKGPLETPVGGGIRSLNVALRQELDLFACVRPVRYFKGVPSPLKHPEKTAITIFRENTEDIYAGIEWNAGTAEVQKVINFLQDDMQVKKIRFPKSSSIGIKPISIEGSQRLIRAAIEYALANNLTKVTLVHKGNIQKFTEGGFRKWGYELAKREYAAELASGQLVVDDIIADNFLQQILLKPERFDVVALTNLNGDYASDALAAQVGGIGISPGANINYQTGHAIFEATHGTAPDIAGQDLANPSSVLLSGCMLFDYIGWSKVSDLIMKAVEKAIANGQVTIDFAKELGVEALTTRQFSEVLLTYL

SEQ ID NO: 20576 - protein, 362 aa, Photobacterium profundum
MAGTYKIAVLPGDGIGPEVMLQAHKVLDAVEEKFGFTLERSEHDVGGIAIDNHGCPLPESTMKGCEESDAILFGSVGGPKWEHLAPNDQPERGALLPLRKHFQLFCNLRPAQIHSGLEGFSPLRADISERGFDIVVVRELTGGIYFGQPKGREGEGPQEKAYDTEIYHRYEIERIARIAFESAMLREKNVYSIDKANVLQSSILWREVVEEVAKDYPEVTLNHMYIDNATMQLIKDPSQFDVMLCSNIFGDIISDECAMITGSMGMLPSASLNQEKFGMYEPAGGSAPDIAGKNIANPVAQILSAALMLRYSLDEEKAARAIEQAVSQALEAGELTADLAGKGAALSTSEMGDKIAAYIRQA

SEQ ID NO: 20577 - protein, 463 aa, Burkholderia cepacia
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 20578 - protein, 634 aa, Xanthomonas axonopodis pv. citri str. 306
MSHTPKSAGSSHAPVNSQTALVIGAIGVVFGDIGTSPLYTLKEAFSPHYGLTPDHDTVLGILSLVFWALMLVVTLKYVTAIMRADNDGEGGIMALTALAQRTLPGGSRSMYVVGILGIFGASLFFGDGVITPAISVLSAVEGLEVAAPKLEPFVVPITLVVLSMLFLAQRFGTERVGKAFGPITLLWFFALGAIGVYNMARAPEVLHALNPWWGVRFFAQHNWHAVFVLGAVVLAVTGGEALYADMGHFGAKAIRRSWQFVVLPMLTLTYLGQGALVLRNPAAVSNPFYEAVPEWALYPMIVLATAATVIASQALITGAYSVASQAMQLGYIPRMHIRHTSHSTIGQIYVPAVNWCLLALVAVAVIGFGDSASLATAYGVSVTGTMLITTVLMIIYARANPRVPAPLLWLFALVFLAVDCAFFYANIIKFLDGAWFPLLLGLILFTLMRTWRRGRKLLHDEIRKDGIKLDTFLPGLMLAPPVRVPGTAVFLTADPMVVPHALMHNLKHNKVLHERNVFLTVETLQVPYAAAGKRLKIDAIGDEFYRVHVRFGFMETPDVPLALMRSCDQGGIYFDPMDTTYFASRETIVASANRGMPIWRDKLFALMHRNAAPATGFFRIPGNRLVELGAQVEI

SEQ ID NO: 20579 - protein, 200 aa, Glycine max
VKVAILTVSDTVAMGAGPDRSGPRAVSVINSSSERLGGARVVATAVVPDDVAKIQDILRRWSDIEQMDLIITLGGTGFTSRDLTPEATKPLIEKETPGLLHVMMQESLKVTKSAMLSRSAAGIRGSTLIINMPGNPNAVAECMEALLPALKHGLKQLRGDKKEKHPRHVPHAEAVPADVWEQSYMLATGAGSDVSCSCCK

SEQ ID NO: 20580 - protein, 432 aa, Desulfitobacterium hafniense
CYAERGPLLYDIPRDYFYGEVEEQILEPHQYRVSQRGCGDLASLDKAAELLFSAERPVIISGRGVVDTQARDIVAGIAGLLTAPVACTYLHNDAFPADHPLWVGPIGYMGSKAAMHSLAEADVILALGTRLSVFGTLPQYDINYFPENAKIIQVDINPRHIARTHPVEIGIIADAKEAAKEILKRLEAKIPAPEVNKGRLATIKARQKDWEDEIVSLAMVDGDPINPRRGLYEVQKALPENAIVATDIGNVSSTANSYLKFTGKGMHIAALTFGNTGFAYPAALGAQLADRNAPVVAIIGDGAWGMSLHEVSTAVEQNLPVVAIVFRNGGWCAEKKNQVDFYNNRFVGADIPNPESFVPVAIAMGAEGVRIEKAEEVGPALARALAARKPTVLEIVCDGTQLAPPFRKDALKLPVRLLPKYQKLDYRNWDKN

SEQ ID NO: 20581 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTEVQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 20582 - protein, 342 aa, Malassezia furfur
MFARAALRNSVRAPASARYFSQTAAANRKVAVLGASGGIGQPLSLLMKLNPKVTELRLYDIRLAPGVAADLSHINTPAVTSGYAQDDLEGAVDGAEIVLIPAGMPRKPGMTRDDLFNSNASIVRDLAKVVAKVAPKAYIGVISNPVNSTVPIVAEVFKKAGVYDPKRLFGVTTLDTTRAATFLSGIAGSDPQTTNVPVIGGHSGVTIVPLISQAAQGDKVQAGEQYDKLVHRIQFGGDEVVKAKDGAGSATLSMAYAAAVFTEGLLKGLDGEAVTQCTFVESPLFKDQVDFFASPVEFGPEGVKNIPALPKLTAEEQKLLDACLPDLAKNIKKGVAWAAENP

SEQ ID NO: 20583 - protein, 571 aa, Zea mays
  unsure (1)..(571): unsure at all Xaa locations
MKVIEKILEAAGDGRTAFSFEYFPPXCDITWGAGGSTADLTLEIANRMQNMVCVETMMHLTCTNMPVEKIDHALETIKSNGIQNVLALRGDPPHGQDKFVQVEGGFACALDLVQHIRAKYGDYFGITVAGYPEAHPDAIQGEGGATLEAYSNDLAYLKRKVDAGADLIVTQLFYDTDIFLKFVNDCRQIGITCPIVPGIMPINNYKGFLRMTGFCKTKIPSEITAALDPIKDNEEAVRQYGIHLGTEMCKKILATGIKTLHLYTLNMDKSAIGILMNLGLIEESKVSRPLPWRPATNVFRVKEDVRPIFWANRPKSYLKRTLGWDQYPHGRWGDSRNPSYGALTDHQFTRPRGRGKKLQEEWAVPLKSVEDISERFTNFCQGKLTSSPWSELDGLQPETKIIDDQLVNINQKGFLTINSQPAVNGEKSDSPTVGWGGPGGYVYQKAYLEFFCAKEKLDQLIEKIKAFPSLTYIAVNKDGETFSNISPNAVNAVTWGVFPGKEIIQPTVVDHASFMVWKDEAFEIWTRGWGCMFPEGDSSRELLEKVQKTYYLVSLVDNDYVQGDLFAAFKI

SEQ ID NO: 20584 - protein, 247 aa, Zea mays
EAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 20585 - protein, 169 aa, Lactobacillus plantarum WCFS1
MQLSIPTINGALAATYSKQAAVAQTYKGHPIISFPVDISDVPAGTHSLAFTFVDHDAIPVGGFTWIHWIAANLPATTTHIPENASQTGAIPMVQGNNSTAGAYVHETDPKVSQHYVGPYPPDKDHRYSFKLFALDTELDLQPGYWLNEFHDAIAGHVLATAKTTVIGKV

SEQ ID NO: 20586 - protein, 437 aa, Desulfovibrio desulfuricans G20
MLCATCTTLRSNACAGRQPAAAWPRPMVSNAAWNALKGYTEACCADAVCVRTEHAGGKQSMNSGPVSVACAQGSHGGDVVRLAARLGISPTDILDFSSNANSLCDDLTRQVLAQTGYAHSHYPDSECTGLRHRIAGFEETQPERILAGNGSSELIYLAMHSLKPRRVLLIAPVFSEYVRACQACGADYRLFETDPYDGFDIPERHICRLHDAVTAYRPDMAVICAPSNPACTDYSRMDDILYALDCPHVLVDNSYLDFLWGTPAYSRHGMAAYAGCTRTETKVISLRSMTKFFYCTGVRLGYCHADEQTIERMNRCKTPWSVWHAAQQAGMAFLDRMDEYRLRLPAMRAEKTAFAGALRNTGIFDNNLVLEGANFVTARLQRPAKAATVYTELLQHGILVRLCDNIPGMPQGFIRMQVREKKAWSRLTAILGTLDAE

SEQ ID NO: 20587 - protein, 1191 aa, Oryza sativa
MAANFSACLVPVAVLALFYLVIFPNDLSQLKSALAPCDAASKSVAAAAAADDDVDFRMFFGILTRPDFYERRALLRMAYALQPPPRRAAIDVRFVMCSLDKEEDAVLVAMEIITHGDILVLNCTENMNDGKTYDYFSALPRLFPAGAEPRYDFAGKIDDDTYYRLGALADTLRRKPRRDMYHGFLNPCHIDPAWQYMSGMGYIVSWDVAEWIAASPELRGREIGYEDDVFGRWLRGAGKGKNRFGEEPRMYDYLDREMYGADVNCFRHELIADTVAVHKLKDRLKWARTLRFFNATDGLKPSKMYHLGMSNKMDGVGVETMQEPMPSTKNMLSWPFASHAPWLIPSLYIWRGAWQGSAPPQPPLPLLYAYDAAASAFPMAQMKQGLDHSAIELSDLQERGMDFHPPGAQQPVNIDSGDEEAPTVRTEKRLTWSTEEDIRLVSAWLNNSNDSISGNFKKNDRYWGDVTAEYNSTTPKNRTRQEKQIKDRFHKIKKNVGRFCCVYKEVKSIYVSGQNDMQLREKAEATYQADYKEGPFSFLHCWNILRDQPKWHAYLEELEKPNKPKMDDEVEVMEQMSTPNSPEDIKRPIGTKTAKAQRNGKGKRKRKAKVYLSDTDDEIDKLKEVQEMANKGRDELLETQRRVASDNLESKKLAHLAAMEHKEAVMLETYQSLMLQNTKDMPDDVRSEHLMALKVMEKIKTKLRIGKIRRKSATRKTIKRDHTAAHHRLIADYFSEDPLYLESIGRQGLSPLQKCTAAMRMLAYGSPADSLDEYLKIGKSTSLQCLDMFARGVIEVFGSEYLRRPTYEDVERMLQVNESRGFPGMLGSIDCMHWRWEKCPTTWRGQFTRGDYGVPTIILEAVATRDLRIWHAFFGVAGIDWAIMMAMKKSFSLLFFLPFLLLAIIYFVIFPNEFRLQSSLAACGDSAPATAADAVAKAAPDIRVLLGVLTRADKYERRALVRLAYALQPAPARAVVHVRFVVCNLTAEEDAALVGLEIAAYGDIIVLDCTENMDNGKTYTYFSAVPRLFAGEPYDYVGKTDDDTYYRLGALADALRDKPRRDAYYGFLTPCHADPRTQYMSGMGYVVSWDVAAWVAATPELQNDLKGPEDKLFGRWLRWGGRGRNVFGAEPRMYDYLDGGMRHGPTCFRHLLQADTVAVHKLKDNLKWARTLNFFNATEGHKASPLFHVDH

SEQ ID NO: 20588 - protein, 251 aa, Eremothecium gossypii
MGSRRYDSRTTIFSPEGRLYQVEYALESISHAGTAIGIMAKDGIVLAAERKVTSKLLEQDTSSEKLYRLNDNITVAVAGLTADAEILVNTARLHAQNYLKMYNEEIPVEVLVRRLSDIKQGYTQHGGLRPFGVSFIYAGYDARYGYQLYTSNPSGNYSGWKAISVGANTQAVQTLLQMDYKDDLTFDDAIKLALKTLSKTTDSSSLSHERLEFATIQRNADGKVVQKIYKLGEIKDLLEKTGINKQEEKED

SEQ ID NO: 20589 - protein, 211 aa, Zea mays
MACKPSPHFLSPHPHSQSRMPRMMCRVALAAVLLCAAAAAALGGKRAPIPDDLRDVIDDEEDDEWRRYGAPPSRGPGRGDGPPPDLSRMDPAALQDELLRGQTGPSFGFVKLRPGTARSQEDVVGIATRWSNVLRTGSVDAKFVAVNFGTLMFTMERGRDILELKEFILSQDEAYEFKVGDRVFRRPGDPPLDQVLDKPQKKKRHKSRDEL

SEQ ID NO: 20590 - protein, 153 aa, Zea mays
MNWKKSPPAVSDGAPDDADDGRLRELGYKQELKRHLSVLSNFSISFTVISVLTGVTTLYNTGLAFGGPATMTLGWFVAGAFTMAVGLSMAEICSAYPTSGGLYYWSARLSGRRWAPFASWITGWFNILPFPSLQWVGTARIDFSLAQLIQVIV

SEQ ID NO: 20591 - protein, 308 aa, Chlamydomonas reinhardtii
MAKEEKNFMVDFLAGGLSAAVSKTAAAPIERVKLLIQNQDEMIKQGRLASPYKGIGECFVRTVREEGFGSLWRGNTANVIRYFPTQALNFAFKDKFKRMFGFNKDKEYWKWFAGNMASGGAAGAVSLSFVYSLDYARTRLANDAKSAKKGGGDRQFNGLVDVYRKTIASDGIAGLYRGFNISCVGIVVYRGLYFGMYDSLKPVVLVGPLANNFLAAFLLGWGITIGAGLASYPIDTIRRRMMMTSGSAVKYNSSFHCFQEIVKNEGMKSLFKGAGANILRAVAGAGVLAGYDQLQVILLGKKYGSGEA

SEQ ID NO: 20592 - protein, 227 aa, Tsuga canadensis
NKGPEDVIVRVIYCGICHSDLIQMRNEMGMSHYPMVPGHEVVGIVTELGSEVKKFKVGEHVGVGCIVGSCRKCGNCNESMEQYCSKRIWTYNDVNHDGTPTQGGFASSMVVDQMFVVRIPENLPLEQAAPLLCAGVTVYSPMKHFGMTEAGKRCGILGLGGVGHMGVKIAKAFGLHVTVISSSDKKKEEALEVLHADAYLVSKDAEKMQEAAESLDYILDTIPVAHP

SEQ ID NO: 20593 - protein, 587 aa, Arabidopsis thaliana
MTLPYRFSSVRNHSLLLKTSHLCTPRSALGCCFSPKESPFFRKNTAQFLSPQKHTSLPLKLVCPLASFSSYADSEGEEQHHADQPIQNPHESSTVSNESDGKGNAEATGDFSGMAQAFHISSTTARAISIVIAFSALTLPIFMKSLGQGLALKTKLLSYATLLFGFYMAWNIGANDVANAMGTSVGSGALTIRQAVMTAAVLEFSGALLMGTHVTSTMQKGILMANVFQGKDMLLFAGLLSSLAAAGTWLQVASYYGWPVSTTHCIVGSMVGFGLVYGGAGAVFWSSLAKVASSWVISPILGALVSFLVYKCIRRFVYSAPNPGQAAAAAAPVAVFVGVASISSAALPLSKIFPIALSQALACGVAGAIVFDRIIRKQLGHLLAKTKSPETSQNQPKTIGFLSDIAGPTGTQLEIVYGIFGYMQVLSACFMSFAHGGNDVSNAIGPLAAALSILQNGAAAGGAEIVIPMDVLAWGGFGIVAGLTMWGYRVIATIGKKITELTPTRGFAAEFAAASVVLFASKLGLPISATHTLVGAVMGVGFARGLNSVRAETVREIVASWLVTIPVGATLAVIYTWIFTKILSFVL

SEQ ID NO: 20594 - protein, 473 aa, Glycine max; identical to SEQ ID NO: 12642

SEQ ID NO: 20595 - protein, 489 aa, Halomonas elongata
MTAQSAQPLYIGGRPVDATSGETFTVTNPYDGSLLATIGQASQADVDSAVQAAQRGQREWAAMTGMERSRILLRAVALLRERNDELAELETRNTGKPISETASVDIVTGADALEYYAGLAPAIEGSQIPLRDTRLVYTRREPLGVIGAIGAWNYPIQIACWKAAPALAAGNAIVFKPSEVTPLTALKLAEIFTEAGLPDGVFNVVQGDGRVGAMLTEHEGIAKVSFTGEVGTGKKVMAAAGGSTLKDVTMELGGKSPLIVFADADLDRAADAAMMANFYSSGQICTNGTRVFVERSAKEAFEAKLVERVARIKAGDPMDPSVNFGPLVSFEHQEKVLSYIALGKEQGARVLAGGDAWNSGEWAKGAWAAPTVFTDCTDEMRVVKEEIFGPVMSVLAFDDEEEVIRRANNTKYGLAAGVFSESLNRAHRVIHQLEAGICWINTWGESPSEMPVGGYKESGIGRENGVETLNHYTQTKSVQIEMGPFESVF

SEQ ID NO: 20596 - protein, 786 aa, Eremothecium gossypii
MWNNLAAEGHMASHTGIFEPMRNNTSPDFRRPTTRIVTTQLTIALSLGLFALVSFSALLRKFPKLYASRKYKVQGLPDWDQGSLFGWLPVLYRITDEQVVEYAGLDAFVLLGFFKMSIKLLAVCCFISMTVISPIRYKFTGRYDDGNDDDDDSRGIYRRLFAAMTAVEPEHDTGPERAEVYLWMYVVFTFFFTFLALRMLMIQTELVVRTRQRYLGRQNTVTDRTIRLSGIPVQLRDEEGLKKRIEELNIGKVSSVTICREWGSLNRLFHYRQLVLRELELKLSDCPQELRYEELYSREEFSLRGRVSGAPAEDAIEQSQSSEDQSRGENEHLYNEIQLKGRPKMRIGLFGWFGEKVDAIDYLSQKLRFIDEEIKQARTKHYSATPTAFITMDSVANAQMAAQAVLDPRVHYFIARLAPAPYDLKWDHVCLSRRERLIKSYSVTLFIGIFSIFWIIPVSYLATLLNIKTISKFWSSLGKFLEDNQWAENIVTALLPTYIFTLFNFGIPYLYERLTEHQGLVSYSEEELSLVSKNFFYIFVNLFLVFTLAGTASNYWAYLSDTTKIAYQLATSVKEFSLFYVDLIILQGIGMFPFKLLLAGSLIGFPFVKITCKTPRQRRELYNPPIFNFGLHLPQPILILLITIIYSVMSTKILASGLAYFIVGYYVYKYQLIYATDHLPHSTGKVWPLVYRRVIMGLLIFQLTMAGTLAGFQGGWILSSCLAPLPLITISFLWDFEKNYLPLSQFIALSSVREHERDSNGSCELAECENFEYPHLVSPLQGPMLD

SEQ ID NO: 20597 - protein, 712 aa, GIBBERELLA ZEAE PH-1
MMLHKLQVAASALALLNGLALAAAPYQQPDCTKEPLRSNGICDTTASPAERAAALVSALTPREKVNNLVSNATGAPRIGLPRYNWWNEALHGVAGAPGNDYNDKPPYDSATSFPMPLLMGSTFDDDLIHDIGEVIGTEARAWNNGGWGGGVDYWTPNVNPFKDPRWGRGSETPGEDALHVSRYARAMECTRDAKVGSIMCSYNAVNGIPACANSYLQETLLRKHWNWTHTNNWITSDCGAMQDIWQHHNYTKTGAEAAKAAFENGQDSSCEYTTTKDISDSYEQGLLTEKVMDRALKRLFEGLVHTGFFDGDKSEWSSLDFDDVNTRHAQDLALQSAVRGAVLLKNDNTLPLNIKKKESVALIGFWADDKTKLQGGYSGPAPHVRTPAYAAKMLGLNTNVAWGPTLQNSSVPDNWTTNALEAAKKSDYIVYLGGLDATAAGEERDRTDLDWPSTQLTLLKKLSNLGKPLVVVQLGDQVDDTPLLKNKGVNSILWVNYPGQEGGTAVMELITGRKGPAGRLPLTQYPSKYTEQVGMLEMELRPTKSSPGRTYRWYSDSVLPFGFGKHYTTFKAMFKSQKIEMNIQKILKGCDATYVDTCPLPPIHLSVKNTGRTTSDFVSLVFIQGKVGPKPYPLKTLAAYSRSHDIKPRATKDVELQWTMDNIARREKNGDLVVYPGTYTLLLDEPTQVKIKVKLTGDKVVLDRWPEFHGSD

SEQ ID NO: 20598 - protein, 380 aa, Oryza sativa
  unsure (1)..(380): unsure at all Xaa locations
SSTSRLPTIVPSVGHHDCSPGLSDNSMSKEDAMSTGDSTESLDIDCLDDGDSEVVSSLQHLADDKLHISDNRDVAASKWTKHGCNSVEIDYIVDIDNNHEDPQLCATLAFDIYKHLRVAETKKRPSTDFVETIQKNIDTSMRAVLIDWLVEVTEEYRLVPETLYLTVNYIDRYLSSKVINRRKMQLLGVACLLIASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSXFLAKFILKPTENPWNSTLSFYTQYKPSDLCNCAKGLHRLFXVGPGGNLRAVREKYSQHKYKFVAKKYSPPSIPAEFFEDPSSYKPD

SEQ ID NO: 20599 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLHQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 20600 - protein, 159 aa, Frankia sp. FE2
ITREEYSRDPRNTAKKAEAYLRGTGFADTAYFGPEAEFYIFDDVRYDYNPYGSLHAVDSIEAAWNTARKEEGGNLGYKPRFKGGYFPVPPTDHFTDLRSEMTRALIRAGITVEMQHHEVGTAGQAEIDIRYDTLLRTADNLMLYKYIIRNVALSRGKTV

SEQ ID NO: 20601 - protein, 543 aa, Trichoderma harzianum
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 20602 - protein, 305 aa, Zea mays
  unsure (1)..(305): unsure at all Xaa locations
EWPRRRRPSCPPISPASPTSAARRRRPLPPSHSSFASAARAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 20603 - protein, 471 aa, Gelidium coulteri
  unsure (1)..(471): unsure at all Xaa locations
SGVIPYAKMGYWDPDYVVKETDVLALFRITPQPGVDPVEASAAVAGESSTATWTVVWTDLLTACDLYRAKXYKVEAVLNSSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYNTLLLTHLEVNLPQGIFFEQDWASLRKVTPVASGGIHCGQMHQLLDYLGIDVVLQFGGGTIGHPDGIQAGATANRVALEAIVIARNEGRDYVAEGPQILRDAAKTCGPLQTALDLWKDITFNYASTDTADFVETPTANV

SEQ ID NO: 20604 - protein, 327 aa, Acidithiobacillus ferrooxidans
MDATDQKRLLREMLFARRFEERCAEAYHERQIGGFLHLYPGEEACAIGVLEKARTGSDYVVTGYRDHIHALKSGMDPKALMAELFGKETGCSKGRGGSMHLFDPDVHFMGGYALVGGPFPLAAGFAKAIQLRGSDEISICFLGDGANNQGTFHETMNMASLWNLPVLFVCENNLYGIGTAIERSTVEINQYKRVAPYRIEAAQCDGQDIDVVMDHAEKAVQYVREKRKPYFLELMTYRLRGHSMSDSGAYRSKEEVEEWAQRDPIGIYKHRLLEAGVVSEDEFHAMDKAILDEIENEIVRFAAESPEPRLEDIARYVYTEKEAGSHG

SEQ ID NO: 20605 - protein, 540 aa, Hordeum brevisubulatum
MGWGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGALELGDYLALGAIFSATDSVCTLQVLSQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSITLSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSEN

SEQ ID NO: 20606 - protein, 336 aa, Antirrhinum majus
APIKIGINGFGRIGRLVARVALQRDDVELVAVNDPFISTDYMTYMFKYDSVHGAWKHHELKVKDEKTLLFGEKPVVVFGRRNPEEIPRASTGAEYIVESTGVFTDKDKAAAHLKGGAKKVIISAPSKDAPMFVVGVNEKEYKSDLHIVSNASCTTNCLAPLAKVINDRFGIVEGLMTTVHSITATQKTVDGPSAKDWRGGRAASFNIIPSSTGAAKAVGKVLPQLNGKLTGMSFRVPTVDVSVVDLTVRLEKKATYEQIKAAIKEESEGKLKGILGYTEDDVVSTDFVGDSRSSIFDAKAGIALNDNFVKLVSWYDNEWGYSTRVVDLIVHMASVQ

SEQ ID NO: 20607 - protein, 252 aa, Amaranthus powellii
LVEALEREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPCTDDLSLHMLG

SEQ ID NO: 20608 - protein, 899 aa, GIBBERELLA ZEAE PH-1
MSGAPRNDTYPYAFASTSASSSSQTPNSDDRDELDFLDDNASNDSGRGRSRDRNHVLGEDPLQGNLSAPMTFKRRQGPSLWSAPSRLLSAITGSRSNASSRGASPAVFPGSNTSPRAEPVVFNEATKDGAPHDWYVEGPGRRVGYEDLTAIDWIFEYTKERQRLRMLYSSASGVIGPLRRLIDASQVWIVLLLTGMLVGAVAAGINVTTDWLGDLKEGYCSSGPEGGHFYLNKAFCCYGYDHNSKCEGWKSWGDAVGVHSKGGKWFVEYLFFVSLAMLFAYVSAVLVQEYAIYAKHSGIPEIKTVLGGFVIRRFLGFWTLVTKSLGLSLAVASGMWLGKEGPLIHVACCCANVFTKLFRNINDNEARKREVLSAAAASGVSVAFGSPIGGVLFSLETLSYYFPDKTMWQSFVCAMTAAVVLQAFDPFRSGKLVLYQVHYSIGWHGFELLPYAILGVLGGIHGGLFIKLNMAIARWKKANRWIPGPFIQVLIVAFFTALINYPNFYMKLQTTELVSNLFSECSQVLDDPIGLCRTGAASAKTIVLLVFASVLGFFLAAVTFGLQIPAGIILPSMAIGALTGRAVGIIMEIWVTNHPGFFLFGSCEPDIPCVTPGTYAIVGAAASLAGVTRLTVSIVVIMFELTGALTYVLPIMIAVMISKWVGDAFSRRGIYESWIHFNEYPFLDNSENNDAIPDIPASQVMTRIEDLVVLTATGHTISSLTTILEMHPYRGFPVISDPREAILLGYISRAELAYNLSAATQAPRSLPPETETFFSHQPMADPRTTLDLRPWMDQTPLTRFSHTSLHLVATYFQKLGLRYLLFSDRGVLQGLLTKKDVWYVLNGAEETRRTMGLASTGAGHETGVADRTPDDIGGGESSGLLRGDGADDGDSIQGEEPML

SEQ ID NO: 20609 - protein, 608 aa, Oryza sativa
MQQQMLWRAFDELTDFNFSIDSLVSLVSQAKLTSDESLITGELGPAVHTETTSLICPGACINNVSVNVKVKLNTVLLILSLVGPYYKLRATNKTQEETKSSATARRVQPPVQACSQRDAPLWCAARLVSSLPQSRSLPFPPPHPQPRAAASPIDRSCAPPPRAPSLAAAAAARRRFDAFFALSGSGMNAWGMGVDRFRLGGAGLVAVDTEHDDSIGVTDESGWPCIELDRRMRRMNGRNPEKNIKMEHENDSSLAWVFHAPYREHENEFPDIPEEKEGNGFAPKSDDPTKAPPPIEVPELSFDELKEKTDNFGSKALVGEGSYGRVYYATLDNGKQVAVKKLDASTEPEVDNDFLTQVSIVSRLRHENFVEMLGYCVEGNQRLVAYEFATMGSLHDILHGRKGVPGAQPGPALDWMQRVRIAIDAAKGLEYLHEKVQPSIVHRDIRSSNVLLFEDYKAKIADFNPSNQSPDMAARLHSTRVLGTFGYHAPEYAMTGQLTQKSDVYSFGVVLLELLTGRKPVDHTMPRGQQSLVTWATPRLTEDTVKQCVDPRLKGEYPPKGVAKLAAVAALCVQYESEFRPSMSIVVKALSPLLQHKPPPPPAVAPET

SEQ ID NO: 20610 - protein, 242 aa, Bradyrhizobium japonicum USDA 110
MLASSASLEGWRAPGPSFEVRPCGALAPQERAPPERTQMRSSGDDGGGRGNRSEVVASIDEAKQFIPLNIAVLTVSDTRALADDKSGQTLADRLTGAGHHLAAREIVTDDVEAIRAVIRRWIADSGVDVVITTGGTGFTGRDVTPEAIEPLFEKRMDGFSIAFHMLSHAKIGTSTIQSRATAGVAGATYIFCLPGSPGACRDGWDGILAAQLDYRTRPCNFVEIMPRLDEHLRRPKAQGATA

SEQ ID NO: 20611 - protein, 108 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGL

SEQ ID NO: 20612 - protein, 477 aa, Polyneura latissima
KSERYESGVIPYAKMGYWDPEYVIKETDVLALFRVTPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKQLGTVIIMIDLVIGYTAIQSMGIWSRKNDMILHLHRAGNSTYSRQKIHGMNFRVICKWMRMAGVDHIHAGTVVGKLEGDPLMIKGFYDTLLLPYLNVNLPQGIFFTQDWASLRKVTPVASGGMHCGQMHRLLDYLGNDVVLQFGGGTIGHADGIQAGATANRVALASMVIARNEGRPFVEEGPQILRDAAKTCGPLQTALDLWKDITFNYTSTDTADFVETPTANV

SEQ ID NO: 20613 - protein, 355 aa, Glycine max
ADPGSFNNSVAEQQAVLETVARVISYVGPPPDEKSFQLHHVFNRAEETPMLIDRKDNVFIISNFKSKYPVLQLDLRLISDLVVAIVSATCGGVAFAFAGQPVITGYLLAGSIVGPGGFNFISEMVQVETVAQFGVIFLLFALGLEFSATKLRVVRAVAVIGGLLQIFLFMCMCGLTVSLCGGKASEGVFVGAFLSMSSTAVVWKFLMEKNTTNALHGQVTIGTLILQDCAVGLLFALLPVLGGTSCVFQGVLSMTKLLVTLIAFLSVLSILSRTCLPWLLKLMISLSSQTNELYQLASVAFCLLVAWCSDKLGLSLELGSFAAGVMIATTDLAQHTLEQIEPIRNLFAALFLASI

SEQ ID NO: 20614 - protein, 689 aa, Azotobacter vinelandii
MAGLASLADLAEGGLDARLVAAGRLAGQLVDGAGEVAGQLVGFVEVLEELRLEAGLVAHLIGGGTGTVQGAHAGIGDGGDGVGGGDHLGFVVRHAAVHDLGLDLAHVPGHEAVAGLAVLDLFLRLELGLGAQGGQQQGGAEAADHQFLHGISLLGPGCFPVTTDGREPSAGGYTPRQTATSASRGPAPAHSAAARRVLPITKEWIAMQLNDARLFRQQAYIEGRWVDADGGQTLAVNNPASNEILGGVPKMGAAETRRAIEAAERALLAWRALTAKERAGKLRCWFELLLEHQDDLARLMTLEQGKPLAEARGEIAYAASFLEWFAEEAKRIYGDTIPGHQADKRILVIKQPVGVCAAITPWNFPAAMITRKAGPSLAAGCTLVLKPASQTPFSALALAELAERAGIPAGVFNVVTGSAAEIGGELTANPIVRKLSFTGSTEIGRQLMAQCARDIKKVSLELGGNAPFIVFDDADLDAAVEGALASKYRNAGQTCVCANRLYVQDGVYDAFAEKLRAAVARLKVGNGLEEGVSIGPLIDDKAVGKVEEHIADAVSRGARVIAGGRPHALGGTFFEPTILAEVPADARVAREETFGPLAPLFRFGDDDEAIALANATEFGLAAYFYARDLSRVFRVAESLEYGIVGVNTGLISTEVAPFGGVKASGLGREGSKYGIEDYLEIKYLCLGGI

SEQ ID NO: 20615 - protein, 510 aa, Pseudomonas syringae pv. syringae
MPLLNWSRHMVCLTAAGLITVPTVYATDTLTRDNGAVVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPAGYRFMDGNGVHAYKLVNAKGEVHYVKFHWKSLQGIKNLDPKEVAQVQSKDYSHLTNDLVGAIKKGDFPKWDLYVQVLKPEELAKFDFDPLDATKIWPDVPEKKIGQMVLNKNVDNFFQETEQVAMAPANLVPGIEPSEDRLLQGRVFSYADTQMYRLGAIGLSLPVNQPKVAVNNGNQDGALNTGHTTSGVNYEPSRLEPRPADDKARYSELPLSGTTQQAKITREQNFKQAGDLFRSYSAKEKTDLVQRFGESLADTHTESKNIMLSVLYKEDRHYGTRVAEVAKGDLSKVKSLAASLKD

SEQ ID NO: 20616 - protein, 497 aa, Glycine max
  unsure (1)..(497): unsure at all Xaa locations
MAALSNGHGSSFFKMPPIKFTKLFINGEFVDSLSGREFETRDPRTGEVITRIAEGAKEDVDVAVKAARAAFDYGPWPRMPGAERAKIMMKWADLVDQNIEEIAALDAIDAGKLYHWCKAVDIPAAASTIRYYAGAADKIHGEVLKASREFHAYTLLEPIGVVGHIIPWNFPSTMFVAKVSPSLAAGCTMVLKPAEQTPLSALFYAHLAKLAGIPDGVLNVVPGFGQTAGVAISLHMDIDKVSFTGSTEVGREVMRAAANSNLKPVSLELGGKSPVIVFDDADVDKAAELALLGILFNKGEICVAGSRVLVQEGIYDEFEKKLVEKAKAWVVGDPFDPKVQQGPQVDKFSSKSASAYKKTQTNGKKVLERGEIINYTRRQQVVEAKFKGQQFETNEXASPVMALMKFKTIEDAIKIANNTRYGLASGIVTKSLDTANTVSRSIRAGIVWINCYFAFGDDIPYGGYKMSGFGRDFGMEALHKYLQVKSVVTPIYNSPWL

SEQ ID NO: 20617 - protein, 286 aa, Zea mays
MHTKKEELKVEEENETSLEDRGIINVDQRPAELMSVLVGVHTMPGKHSRRHLIRMAYALQQQTPALRAAARVDVRFVLCARPMPPEHRVFVALEARAYGDVLVLDCAENAEEGKTYTYFASLPTMLGSGSGGGGGRPYDYVMKVDDDTFLQLDALVDTLRSAPREDMYCGVGLPFHDRQFPPFMLGMGYLLSWDLVEWIATSDMVRREAMGVEDLTTGKWLNMGHKAKNRVNIFPRMYDYKSAKGEDFLENTIGVHQLKQDLRWAHTLEHFNVTRLEPSSMLLHNF

SEQ ID NO: 20618 - protein, 422 aa, Photobacterium profundum
MEILANYGTILILVAAIFGLLMAIGIGANDVANAMGTSVGSKALTVKQAIIIAMIFEFAGAYLAGGEVTDTIRKGVIDMSFYADQPEVLVYGMMSALLAAGTWLLLASYMGWPVSTTHSIIGAIIGFACISVGTEAVDWQSVQGIVGSWLITPLISGLFAYLIFVSAQRLIFDTDSPLINAKRFVPIYMFITAMVIALVTITKGLKHVGLHLSSGEAWAASAAVSAVIMIFGYIYISKKYTDDGSSVDSNGYAGVERVFSLLMVVTACAMAFAHGSNDVANAIGPLSAVVSTVQNMGQIAEKTTIAWWILPLGGVGIVIGLATMGHKVMATVGTGITELTPSRGFAAQLATASTVVLASGTGLPISTTQTLVGGVIGVAVARGIGALNLGVVRNIVASWVVTLPAGALLAVIFFYIIQAIFG

SEQ ID NO: 20619 - protein, 598 aa, Myxococcus xanthus
MSFLQQALVFLAAVVLADPLSRRLGLGSVLGYLAGGAVIGPWGLKLISDVEHIFHVAELGVVVLLLFVSLELQTSRLWALRRSVFGLGGAQVLFTGALLASVGLLCSLTWGAAIVTGFGLSLSSTAFALQLLVERNRLTTPYGQLAFGILLFQDLAVVPLLALLPLLGDGGAPSPGTVWLLLLKDVGVLLAEVLSGRYLVRPAFRAVAATHRQELFTATALLLVVATASVINAVGLSMGLAASLAGVLLADSEYRHELEADLAPFKGLLMGLFFISVGMTVNLSLILQKPLLVFGLVLGLVALKGAVLYGLGRMALGRREPALDLAVVISQGGEFAFVLFSLATAQHVMERSLSELLVVVVGLSMAVLYAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFVRARNRVHAYELLDMGIERVMRETFLDRLEMGAGVLQELGLTYSESRRAQERRMMEHDERLLRETGRFHRDEQKLVGLGDKDRKELERLFEKEEGRNPTEPREPPPA

SEQ ID NO: 20620 - protein, 214 aa, Glycine max
MSATVTLTLNLCRSSIVASCPHYSHKPNPNFNAFFSFSLSLSLSHHRRIVIYKKPFPSRRTWLYGYMNRDRDYELENGLALFGSDEELATQIPTQAQSLVEGSGSIRIAEFKPVPDVDYLQELLAIQQQGPRAIGFFGTRNMGFMHQELIEILSYAMVITKNHIYTSGASGTNAAVIRGALRAEKPEWLTVIFTSRLSPQPPESQEPLSKVGMG

SEQ ID NO: 20621 - protein, 293 aa, Actinobacillus pleuropneumoniae serovar 1 str. 4074
MSYAKEIDHLNHTLADLNGNINASFEFFPAKNEKMEMLLWDSIHRLAPLKPKFVSVTYGANSGERKRTHSIVKRIQQDTGLAAAPHLTGIDANPEQLRIIAQDYWENGIRHIVALRGDEPAGYAKKSFFAKDLVKLLKEVADFDISVAAYPEVHPEAKSAQSDLIYLKQKVEAGANRAITQFFFDIDSYLRFRDRCVTVGIDVEIVPGILPVTNFKQLQKMTKITNVKVPHWMHKMYEGLDDDQTTRNLVAASIAMDMVKILSKEGVKDFHFYTLNHSELTYAICHALGVRPT

SEQ ID NO: 20622 - protein, 359 aa, Thermosynechococcus elongatus BP-1
MALVPMRLLLDHAAENGYGIPAFNVNNMEQIQAIMQAAHETDSPVILQASRGARKYAGENFLRHLILAAVETYPHIPIVMHQDHGNEPATCYSAIRNGFTSVMMDGSLEADAKTPASYEYNVAVTSEVVKVAHSIGVSVEGELGCLGSLETGKGEAEDGHGFEGALDHSMLLTDPDQAVDFVERTQVDALAVAIGTSHGAYKFSRKPTGEILAISRVEEIHRRLPNTHLVMHGSSSVPQELIDIINQYGGTIPETYGVPVEEIQKGIKSGVRKINIDTDNRLAITAAVREALALAPKEFDPRHFLKPSIKYMQKVCADRYQQFGTAGNASKIKQLSLDDYAAKYAKGELKQVTQKTVVV

SEQ ID NO: 20623 - protein, 207 aa, Campylobacter fetus
MVIVKKISAIEVLDSRGNPTIKTKVELCDGSIGEAIVPSGASTGKRERLELRDGGEAFGGKGVLKAIKNVNSMIAEEICGKDAYNQKAIDDAMLALDGTDNYSRIGANAVLGVSMAVARAAANSLNIPLYRYLGGANACTLPVPMFNIINGGAHANNSVDFQEFMIMPFGFSKFSNALRAATEVYQTLKKILNDLGHSTAVGDEGGF

SEQ ID NO: 20624 - protein, 172 aa, Nostoc punctiforme
MDLKSLVRDIPDFPKPGILFRDITTLLRDPEGLRYTIDFLTQKCKEAEIKPDYVIGIESRGFIFGSPLAYQLGAGFIPIRKRGKLPAAVHSIEYDLEYGTDCLEVHQDALRHSSRVLIVDDLIATGGTASATAKLVQKIGCELVGFGFIIELRDLEGRKYLPDVPIISLIEY

SEQ ID NO: 20625 - protein, 165 aa, Triticum aestivum
MAQESLRLVCPPVSAHEGRLPRQYTLEGQGAKKDISPPLEWYGVPDGTRSLAVVVQDVDADERVPWTHWVVVNISPEEKGLPEGFSGAGGNANAGGGDGGVQEGVNDWKQPGWRGPVPDSHGHRIQFRLYALDDVLSLGNKVTVDKVMEAIEGHVLGEAEITAVF

SEQ ID NO: 20626 - protein, 184 aa, Oenococcus oeni MCW
MKIAFQTAAKRNHHVTLVDKANVLATSKLWRRIANQVAKEFPEISFDSCYVDAAAMKIISAPEKFDVIVTENLFGDILSDEASQITGSLGTIPSISRGDHGPALYEPIHGSAPDIAGKGIANPLSMINSVAMMLDHSFNRKDLAKRITDSVNKTIEGGTTTPDLGGNSKTTVVTNAIIKRIEEN

SEQ ID NO: 20627 - protein, 194 aa, Zea mays
  unsure (1)..(194): unsure at all Xaa locations
MQDQLVCHGCRNTLMYPRGATNVRCALCHIVNMVPLHPHPPPPPPPHHAHAGMDMAHIVCGGCRTMLMYTRGASSVRCSCCQTVNLVPGPPPSNQVAHINCGNCRTTLMYPYGASSVKCAVCQFVTNVNMSNGRVPLASNRPNGTAAPGTMPXSTSTSTPPSQTQTVVVENPMSVNESGKLVSNVVVGVTTGQK

SEQ ID NO: 20628 - protein, 573 aa, Saccharomyces cerevisiae
MPIRSISSASQMNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 20629 - protein, 227 aa, Ipomoea batatas
MAREKIKIKKIDNITARQVTFSKRRRGLFKKAEELSVLCDADVALIIFSSTGKLFDYASSSMKGILERRNLHSKNLEKMDQPSLELQLVENANHSRLSKEIADMTHRLRQMRGEDLQGMSIEELQQLERSLETGLSRVIEKKGEKIMKEINELQQKGMNLMEEKERLTQQVMAISNGQRVTAVINSDNMLNEEGLSSESITNVCNSTSPPQDYDDSSDTSLKLGLPY

SEQ ID NO: 20630 - protein, 68 aa, Desulfitobacterium hafniense
MSYIEEIYGREILDSRGNPTVEVEVLLEDGSMGRAAVPSGASTGAFEAVELRDGDKAVFKVKRGTIDF

SEQ ID NO: 20631 - protein, 172 aa, Talaromyces emersonii
PIPLDGGSKDGQEATPLATIAYSPDYIEATSYLRAVMAANEMSERALKLTQDVISMNPAHYTVWLYRAKILFALNKNLDDELTWLNKVSLTYLKNYQIWHHRQVIMSSREAFPTLPPKELDFLMEMFAQDAKNYHVWTYRHWLVRHFNLWDSEREIRDVETLIDADVRNNSA

SEQ ID NO: 20632 - protein, 137 aa, Glycine max
  unsure (1)..(137): unsure at all Xaa locations
ARSMISFPAVTTVNRAGAGMVVPFTGLKPMAGSPTINTNNDITFIASRGGRVQCLHVCPPADKNNLETLSYLPDLDXAQSSKREEYLLTTGWLRCXGIRIKHGFVIREHTTLPGFYNGLLGTMWILPIDSCSHASNV

SEQ ID NO: 20633 - protein, 513 aa, GIBBERELLA ZEAE PH-1
MANIIKSALPTHLKPNTGDEQGNERRHGKTRSHMAFENTSTNVAAAQMRNALTNLAETLFETEMDNFFALFRRYLNDKAKGNAVDWDRIAPPAQGQVVDYDDLANTESVQFLNKLAVLKLNGGLGTSMGCVGPKSVIEVRDGMSFLDLSVRQIEYLNRTYDVNVPFILMNSFNTNDDTAAIIKKYEGHNVDILTFNQSRYPRVYKDSLLPVPKDNDSPINEWYPPGHGDVFESLYNSGILDKLLERGIEIVFLSNVDNLGAVVDLRILQHMMETDSEYIMELTNKTKADVKGGTIIDYEGSVRLLEIAQVPKEHVNEFKSIKKFKYFNTNNIWLNLKAIKRVVENDELEMEIIPNGKTIPGDKKGESDISIVQLETAVGAAIRHFNNAHGVNVPRRRFLPVKTCSDLMLVKSDLYTLKHGQLQMSAARFGDAPLIKLGGDFKKVSDFQKRIPSIPKVLELDHLTITGAVNLGRGVTLKGTVIIVATEGSTIDVPPGSILENVVVQGSLRLLEH

SEQ ID NO: 20634 - protein, 380 aa, Phanerochaete chrysosporium
MSKRTFKIVILPGDGIGPEVVAEATRVLEVVSASSSDVEIKLETHDFGGCSIDKHGEPLTAATLEACKLADAILLGAIGGPKWGVNSKVRPEQALLALRKALGLYANIRPANFASDSLLAYSPLKPSVARGVDIIVIRELIGGAYFGERKELGARAQEDAAWDTMIYSVPEVQRITRSRRQVASPDPPLPVHSIDKANVLASSRLWRKVATETIQNEFPQLKLDHHLVDSASMLIVANPKKLNGVILTENLFGDILSDESSVIPGSLGLLPSASLAARPLWPNTAHRRSSPRRVYEPIHGSAPDIAGQGIANPIGTILSAAMLCGTRSVWRSPAKAIEAAVEGARRQGDRREGLRTADLGGSSKTKDIGHKVVEILKATL

SEQ ID NO: 20635 - protein, 209 aa, Oryza sativa
MVGTSSWSSSSTCTSSLGSLDDDVVVACVVKAADAAAEGTFVKFLCSYGGRILPRHADGALRYVGGDNRVVSVDRSLPFHELQRKLREMCGWEAVCLRCQLPTEDLDALVSVTGDDDLANLLEEYDAASRDRLQPLKIRAFLFPRTTTTTPPPPSRTVPHALYHRQTGSAPSCASRWAAHQMSSPPARVLHQQQHHNRHSGEARPHRYL

SEQ ID NO: 20636 - protein, 862 aa, Volvariella volvacea
MPPSDFAKANIDEIVEQLTLDEAISLTAGVGFWHTHAIERLGVPAVKVSDGPNGIRGNHFFMGTPAKCLPSSTALGATWDPEVVEEVGLKLLAPEAKLRAASLVLAPTSNIQRNPLGGRSFESFSEDPYLSGIISASYVNGVQKGGIGATIKHFVGNDKEDDRQGYDSIISERALREIYLLPFMLTQKYAAPWAIMTAYNRVNGVHVAEDPFLLKQVLRNEWKYKGLIMSDWFGMYSVDHGIKAGLDLEMPGINKWRTLDLVNRTIQARKLTPRDIKDRARVVLELVKKCAQGAPEILDGDGEERTVELESDKLLMRRIASESIVLLKNDNVLPLKPEGGAIKKIAVVGGNAKAQVLSGGGSAALKASYFISPYDGIKAALEPHGVEVTFSEGARAYKTLPTLEWDLETETGERGWIGTWHTHESDDSMTALDQPFIAPRLVDETRIFISTSYPKGITKRWTMRLKGYLKPREKDTNFEFGLIAAGRAKLWVDGQLVIDNWTRQRRGEAFFGSGSQEETGVYLLKAGKKHEIYVEYCNVRAPADGDEDEAIMDSNPGVRLGGAEVANADDLLSEAVKLASEADAVIAVVGLNADWETEGNDRRTLALPGRTDELVEKVAKVNSKTVVVTQAGSAITLPWLDSVAAVVHAWYLGNATGDAIADVLFGKQNPSGKLSLTFPKRLEDVPSHGHFGSENGKVRYAEDLFVGYKHYHHRNIEPLFPFGFGLSYTTFSLSNLQLSAPVIDHATSSFSLTATLSITNTGPVTGSEVAQLYVSYPETSELTHAPLQLRAFKKVKDLQPGETREVKLELDKYAVSYWNDRYQTWAVENGEYEIKVGNSSVSKDLTLVQRFVVKDGFEWRGI

SEQ ID NO: 20637 - protein, 1661 aa, Oryza sativa
MPHTLLRDLVNINLLDRRWLSEMGECKLSASMDNYVGAKTSHTCLIWVHRAPTLYDHQGAEKCKANKKFLHVDGIIFIILKSKLYFALCKLHRVSLVFTWTQLLCGTAPAEAYIYSITEQRNRGDIIEKSSEQTPTAMSRSGVVAMDAAGADADQARLHQLGYRQELKRGLSLVSNFAFSFSIISVLTGVTTTYGTGLRYGGPVSMTLGWLVVSAFNGCVALSMAEICSAYPTSGGLYYWSAKLAGKEWAPLASWVTGWFNIVGQWACTTSVDFSLAQLLQVIILLATGGANGGGYMASKYVVLAIYSVILILHGLINSLPIHWLSWFGQLGAFWNVAENGMGIHQKAYILAVGLLMSQYSVIGYDTSAHMIEETKNADWSGPMGIITSVGLSTMFGWIYLIALTSIMTDIPYLLNPSNDAGGYAIAQALYTSFHRRYGTGAGALACLGVIAVAIFLCGSACITSNSRMGYAFSRDGAMPLSRVWHRVDSREVPLNVVWLSVAVAFVMALTVNSKSIAAAAAVNFSSCSDLVVFSWQSLGSQVAFQAMVSVTTLGLYIAYALPVFFRVTTARKSFVPGQFHLGRYGLMVGWMAVVWVATVTVLFSLPVAYPVAKETFNYTPVAVGGVLLLSLVAWVFHARFWFQGPVTNVDARSRQRRLSPPRAAGRESRRRRLPPSRAARRGDADGGGAASRHVAAVDDPRAVEEHGDQEPAANGVDQAAAANGGNQAVAANGQPPRSPAAALRRLHDLIATDAFHRDHQAPAPLLPPPHAALLLPSRPLGLPRPRRVHLRGVDIAARESHPVIRFAHADANLRRLPHARRSLGEDGRRQGETGGTRPAEGRLPLSSPRPLDADADVEAVPELTVVDPDGVSAGAGGIAGEGNLDVALLLQCVKPALRREGGNTQLATWTASTPLCLWRGLRWRLGLRMPFPFIMLQSRWPAEEKSDGGARWRRHQSPPLPPPSPSPTSPATSSRPCESRKPSRWIKPGLKTTEEPKTNGFRSYCLNQTLVPCTEPVKFLQIYCKGSTIQMALSRSVEVAVPADPAGDGDRDKIRLRQLGYKQELKRGLSVLSNFAFSFSIISVMAGVTTTYSTGLRYGGPVSMTLGWLVVSAFNGCMALSMAEICSAYPTSGGLYYWSAKLAGNDWAPFASWITGWFNITGQVGTFGFLGPGFSLIDGPFYWAMSTERNKFTLGPFICCPVRFSSLNHKTGHRRCRRRRPCCSSPRPSPRRRRRPACRDCRGGGEEEDEDAGGSSGGEEEDEDAGGGGALGVVSWAATTSVDFALAQLVQVIVLLSTGGANGGGYMASNYVVLAIYGAMLVIHGAINSLPIQCLSWFGQLGAFWNAAGVFVLVALIPAVATERASVEFIFTHFNTENGMGIRDKAYILLIGLLMSQYAMAGYDTSAHMTEETKNADWSGPIGIVTSVALSTVFGWIYIVSLTSAVTDIPYLLSPDNDAGGNAVAQAFYTTFHRRYGSGLGGILCLGVVAVAVFLCGLACITSNSRDGAMPFSKVWHRVNKQEVPINAVWLSVVVAFIMALTSLGSQVAFQAMVSIATIGLCISYALPIFFRVTTARGSFVPGPFHLGKYGIVVGWAAVLWVAAVTVLFSLPVAYPVAEETFNYTPVAVGGVLLLTVGAWALRARFWFQGPITNTNDGPL

SEQ ID NO: 20638 - protein, 387 aa, Glycine max; identical to SEQ ID NO: 4377

SEQ ID NO: 20639 - protein, 243 aa, Zea mays; identical to SEQ ID NO: 4427

SEQ ID NO: 20640 - protein, 213 aa, Haemophilus somnus 129PT
MSDQSCIIIAIAGASASGKSLIASTIHEELCNELGCEEIGIVTEDSYYKDQTHLSFEERIKTNYDHPNSMDRDLLIQHLCDLKKGKAVDIPVYSYVEHTRTQEVTRFEPKKVIILEGILLLTDERIRQEVNMSVFVDTPLDICFIRRLQRDMEERGRSLQSVIDQYKSTVRPMFLQFIEPSKQYADIVVPRGGKNRVAINMLKVQIQHLLNNK

SEQ ID NO: 20641 - protein, 347 aa, Zea mays
IEEIPNLTSGCTEFVESAQQILEERKLNQTLLANHTTLLDLLEIPPLMDTYGTFILPFPCLFTLCLSRLLMTMSFVRCIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRVHLFDVVNQYRAIFNNDKSGNDENSEGGLLFSWAMQQVSNHLATLQVMLPSITEGGSLSNILEQCMYCAMGLGLVGLDFRGLLPPIFEDAVLNLFSKNMSMAVENFQVVLDSHRWVPMPSVGFVANGVVDDTSDDVTPPSVLMEHPPLAVFVNGK

SEQ ID NO: 20642 - protein, 509 aa, Geobacter metallireducens
MELPLCDFPFTLQLDLQKTTKESSEMMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 20643 - protein, 345 aa, Thermus aquaticus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 20644 - protein, 435 aa, Caloglossa leprieurii
ETDVLALFRVSPQPGVDPIEAAAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQTMAIWARKNDMILHLHRAGNSTYSRQKIHGMNFRVICKWMRMSGVDHIHAGTVVGKLEGDPLMIRGFYNTLLMPYLDINLPQGIFFQQDWASLRKVTPVASGGIHCGQMHQLLDYLGNDVVLQFGGGTIGHPDGIQAGATANRVALESMVIARNEGRDYVAEGPQILRDAAKTCGPLQTALDLWKDITFN

SEQ ID NO: 20645 - protein, 773 aa, Hordeum vulgare
MSLQVEDPRSAETPAPLKRHDSLFGDAEKVSDSKHHGSQVSWMRTLSLAFQSVGIIYGDIGTSPLYVYSSTFPDGIKNRDDLLGVLSLILYTLIIIPMLKYVFIVLYANDNGDGGTFALYSLISRYAKIRLIPDQQAEDAAVSNYHIEAPNSQLKRAQWLKQKLESSKAAKIVLFTLTIPSMVIGDGTLTPAISVLSAVSGIREKAPSLTQTQVVLISVAILFMLFSVQRFGTDKVGYTFAPVISVWFLLIAGIGMYNLVVHDIGVLRAFNPMYIVQYFIRNGKSGWVSLGGIILCVTGTEGMFADLGHFNIRAVQLSFNGILFPSVALCYIGQAAYLRKFPDNVANTFYRSIPAPMFWPTFIVAILAAIIASQAMLSGAFAILSKALSLGCMPRVRVIHTSHKYEGQVYIPEVNFLMGLANIVVTVAFRTTTSIGHAYGICVVTTFAITTHLMTVVMLLIWKKHVMFIMLFYVVFGSIELIYLSSIMSKFIEGGYLPICFALVVMSLMAAWHYVQVRRYWYELDHIVPISEMTMLLEKNEVRRIPGVGLLYTELVQGIPPVFPRLIQKIPSVHSIFIFMSIKHLPISRVVPTERFIFRQVGPREHRMFRCVARYGYSDTLEEPKEFAAFLVDRLKMFIQEESAFALVQDQEESGGAGDVSDALARPRRSTVHSEEAVQGQARVSSHSASGRMSFHTSQAVEEEKQLIDREVERGMVYLMGEANVTAEAKSSILKKIVVNHVYTFLRKNLTEGHKVLAIPKDQLLKVGITYEI

SEQ ID NO: 20646 - protein, 476 aa, Ptilophora rhodoptera
SKRYESGVIPYAKMGYWDPDYVIKETDVLALFRITPQPGVDAVEASAAVAGESSTATWTVVWTDLLTACDLYRAKAYRVDPVPNTTDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAGTGEVKGHYMNVTAATMEDMYERAEFAKQLGTVIVMIDLVIGYTAIQTMAVWARKNDMILHLHRAGNSTYSRQKSHGMNFRVICKWMRMAGVDHIHAGTVVGKLEGDPLMIRGFYNTLLLSHLDMNLPQGIFFEQDWASLRKVTPVASGGIHCGQMHQLLDYLGEDVILQFGGGTIGHPDGIQAGATANRVALEAMVIARNEGRDYVAEGPQILRDAAKTCGPLQTALDLWKDITFNYTSTDTADFVETPTANV

SEQ ID NO: 20647 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 20648 - protein, 247 aa, Prunus dulcis
  unsure (1)..(247): unsure at all Xaa locations
RIENKINRQVTFAKRRNGLLKKAYELSVLCEAEVALIIFSNRGKLYEFCSSSSMLKTLERYQKCNYGAPETNVSAREALELSSQQEYLKLKARYEALQRNQRNLLGEDLGPLSSKELESLERQLDMSLKQIRSTRTQCMLDQLTDLQRKEHMLNEANKTLKQRLFEGYHVNSLQMNPNADEYGRQQTQAHGDGFFHPLDCEPTLQIGYQNDPISVVTAGXSVSNYMAXMVAMIIXKCVLESTXSHEW

SEQ ID NO: 20649 - protein, 120 aa, Oryza sativa
ILSKSVDNEMVLWKPKPKEQSPGEGSIDILQKYPVPECDIWFIKFSCDFHFNQLAIGNREGKVFVWEVQSSPPVLTARLTNPQCKSAIRQTAVSFDGSTILACSEDGSIWRWDEVDHPKA

SEQ ID NO: 20650 - protein, 376 aa, Arabidopsis thaliana
MAKEIESATDLGDTNIKGVLVHGGRYFQYNVYGNLFEVSNKYVPPIRPIGRGAYGFVCAAVDSETHEEIAIKKIGKAFDNKVDAKRTLREIKLLRHLEHENVVVIKDIIRPPKKEDFVDVYIVFELMDTDLHQIIRSNQSLNDDHCQYFLYQILRGLKYIHSANVLHRDLKPSNLLLNSNCDLKITDFGLARTTSETEYMTEYVVTRWYRAPELLLNSSEYTSAIDVWSVGCIFAEIMTREPLFPGKDYVHQLKLITELIGSPDGASLEFLRSANARKYVKELPKFPRQNFSARFPSMNSTAIDLLEKMLVFDPVKRITVEEALCYPYLSALHDLNDEPVCSNHFSFHFEDPSSTEEEIKELVWLESVKFNPLPSI

SEQ ID NO: 20651 - protein, 485 aa, Nitrosomonas europaea ATCC 19718
MDDAKKKLTTSAGAPVADNQNVMTAGPRGPMLLQDIWFLEKLAHFDREVIPERRMHAKGSGAYGTFTVTHDITRYTRANIFSQIGKKTDLFVRFSTVAGERGAADAERDIRGFAIKFYTEEGNWDLVGNNTPVFFLRDPLKFPDLNHAVKRDPRTNLRSARNNWDFWTLLPEALHQITIVMSDRGLPATYRHMHGFGSHTFSFINARQERYWVKFHFRTQQGIKNLTDAEAEALVGKDRESHQRDLYESIENGEFPRWTLFVQIMPESDAASLPYNPFDLTKVWPHKDYPLIEVGVMELNRNPENYFAEVEQAAFNPASVVPGISFSPDKMLQGRLFSYGDAQRYRLGVNHYQIPVNAPRCPFHHYHRDGAMRVDGNQGSTLGYEPNSYQEWQQQPEYAEPPLTLEGAAAHWNHRVDEDYYIQPGNLFRLMNSSQQQVLFDNTARSIGEAPREIQIRHITNCLKADRAYGEGVARALGIALSEVD

SEQ ID NO: 20652 - protein, 192 aa, Cytophaga hutchinsonii
MNKNISILVLDNYDSFTYNLVHIIKALGYTNLEVHRNDKITLDEIQRFDKILLSPGPGIPSEAGILQDVIRTYAGKKSIFGVCLGHQAIGEVFGGTLTNLEKVYHGIASKTQILNKGVLFEGLPEEITTGRYHSWVVDTKNFPDVLEITATDEQGKIMALKHKTLDLVGVQFHPESILTEFGKKMVQNWLEA

SEQ ID NO: 20653 - protein, 477 aa, Phaeothamnion confervicola
  unsure (1)..(477): unsure at all Xaa locations
KSDRYESGVIPYAKMGYWDADYAVKATDILALFRITPQPGVDPVEAAAAVAGESSTATWTVVWTDLLTACDVYRAKAYRVDPVPGTTDQFFAYIAYECDLFEEGSLPNLTASIIGNVFGFKAVKALRLEDMRIPYAYLKTFQGPATGLIVERERLDTFGRPLLGATVKPKLGLSGKNYGRVVYEGLRGGLDFLKDDENINSQPFMRWRERFLYVMEGVNRASAASGEVKGSYLNTTAATMEXMYERADYAKAIGSVIVMIDLVIGYTAIQSMAIWARKADMILHLHRAGNSTYARQKNHGINFRVICKWMRMAGVDHIHAGTVVGKLEGDPLMVKGFYNSLLLTKMEVNLPQGIFFDMDWASLRKVVPVASGGIHCGQMHQLVYXLGDDCVLQFGGGTIGHPDGIQAGATANRVALESMLIARNEGKDYLNEGPQILRDAAKMCGPLKTALDLWKDISFNYTSTDTADFVETATESK

SEQ ID NO: 20654 - protein, 172 aa, Zea mays
  unsure (1)..(172): unsure at all Xaa locations
ESSLVPPPPKASISPRCRSFASSSSSTIRRKPLTLVSSKSSDAEEVSDTEDEWLKKLPEKNKPLYSHSLPCIEAWLRKLGFYQSKDDRAVWLIQKPDWHAQLSLDVTDLCIRYMKRGPGNLERDMERRXFSYALSREDTENALLGGTLKNKKRLGGASLVNFAFSVVFYMMD

SEQ ID NO: 20655 - protein, 466 aa, Oryza sativa (japonica cultivar-group)
MGPTSRNHKSSQKDVAPNEAKPPRYPQRNRSITASASASAFASPAVANSRVAKERPSSSTAGEGEPQETVLKLPSIPTLPARMAKLVPLEGLGCEAAVGSLTPSREREYKVTNKHTEGRRPVYAIVFNFLDVRYYDIFATACGPRLSTYRCLMNGKFALLQSYLDDDMNESFFTVSWACDIDGNPLLVAAGSTGIIRVINCATEKIYKSLVGHGGSVNEIKSQPSNPSLIISASKDESIKLWNVQTGILILVFGGVGGHRHEVLGVDFHTSDIYRFLSCGMDNTVRIWSMKEFWEYVEKSYSWTDATSKFPTKFVQFPVLCAEIHSNYVDCTKWLGDFVLSKSVENEILLWESITKEENPGEGHIDVLQKYPVPECNIWFMKFSCDFHHNQLAIGNRDGKVYVWKVQTSPPVLIARLNNPQVKSAIRQTAVSFDGSTILACTEDGNIWRWDEVDHPTAPVPSKKQK

SEQ ID NO: 20656 - protein, 396 aa, Cucumis sativus
MALKFHPLTSQSPKLPSFRMPQLASLRSPKFVMASTLRSTSREVETLKKPFMPPREVHLQVTHSMPPQKMEIFKSLEDWAEENLLVHLKPVERCWQPQDFLPDSAFEGFHEQVRELRERAKELPDEYFVVLVGDMITEEALPTYQTMLNTLDGVRDETGASPTPWAIWTRAWTAEENRHGDLLNKYLYLSGRVDMRQVEKTIQYLIGSGMDPRTENNPYLGFIYTSFQERATFISHGNTARLAKEHGDIKLAQICGTITADEKRHETAYTKIVEKLFEIDPEGTVIAFEEMMRKKVSMPAHLMYDGRDDNLFHHFSAVAQRLGVYTAKDYADILEFLVGRWKVESLTGLSGEGQKAQDYVCALPARIRKLEERAQGRAKEGPTIPFSWIFDRQVKL

SEQ ID NO: 20657 - protein, 264 aa, Hypocrea jecorina
MGHEDAVYLAKLAEQAERYEEMVENMKIVASEDRDLTVEERNLLSVAYKNVIGARRASWRIVTSIEQKEESKGNSSQVALIKEYRQKIEAELAKICDDILEVLDQHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSAGQVEAPPKEDTPAEAAAPAEEPKAE

SEQ ID NO: 20658 - protein, 367 aa, Glycyrrhiza echinata
MAFSTNGSEEIELYHAQIHLYKHVYNFVSSMALKSAMELGIADVIHNHGKPITLPELASALKLHPSKVGILYRFLRLLTHNGFFAKTTVPSQNGKDGEEEEETAYALTPPSKLLVKGKPTCLASIVRGALHPSSLDMWRSSEKWFKEDKELTLFESATGESFWDFLNKDSESGTLSMFQEAMAADSQMFKLALKECRHVFEGLESLVDVGGGTGGVTKLIHEEFPHLKCTVFDQPQVVGNLSGNENLKFVGGDMFKSIPPADAVLLKWVLHDWNDELSLKILKNSKEAISGKGKEGKVIIIDISIDEASGDRELTELQLDYDLVMLTMFNGKEREKKEWEKLISDAGFSSYKITPICGFKSLIEVFP

SEQ ID NO: 20659 - protein, 208 aa, Prochlorococcus marinus subsp. pastoris str. CCMP1378
MNFNGKTLIIIGSILFFFQLGNFFSIDSISPALERAQVLSAISSVIIVLIGFLFKQFNPNLGDKVKLKGENKFIFEPDIPRDILDELAWGTEAILTSTAAATVLIHNDGKNILKRGITTNNVFKPGETCNRSLKDMKLISLANTKFYPGRDEFFSFCPNVPSILIIPINSKSFILIGGWSYRCFTKSDEKWINNWSKKVNNIFIKNSF

SEQ ID NO: 20660 - protein, 532 aa, Oceanobacillus iheyensis HTE831
MAKKDESMNKSNLENDMSLTNRQGHPVTNNQNIRTVSNRGPATLENYDFIEKISHFDREKVPERIVHARGAGAHGYFETYGTVGNDPVSKYTRAKVFQDKGKQTPVFVRFSTVVHGNHSPETVRDPRGFAVKFYTEDGNWDLVGNNLKIFFIRDAMKFPDMIHAFRPDPVTNIQDSERFFDFCANSPESFHMVTFVYSPWGIPANYRMMQGSGVNTYKWVNKDGEAVLVKYHWEPKQGIKNLTTKEAEEIQATNFNHATQDLYDAIENGDYPEWELFVQIMSDDEHPELDFDPLDDTKLWPEDQFPWHPVGKMVLNKNPENYFTEVEQAAFGTGVLVDGLDFSDDKMLQGRTFSYSDTQRYRVGANYLQVPVNESKKRVATNHEGGQMRQKNDKAPSQNPHINYEPSVLGGLEENEQTGKEYTPHIEGNLVRESIDRNDNTKQAGHTFREFEEWEKAELISNLVGDLSVSDQRIQDKMIALAEEADDEYGRRLREGLEQAKKMGTPHNPLGAKDAEQAPKKAIDKGHDADPY

SEQ ID NO: 20661 - protein, 398 aa, Glycine max
MGAEQQHMDSHKKMVIAVAVASTSLGAVILCVLCIWIYYTKYPSKSKGKNVQRSDAEKGLASSPFLSKFSSIKLVGKKGCVPIIDYKQIEKATGNFKEINILGKGGFGCVYKAHLDDNLDVAVKKLHCENQYAEQEFENEVDLLSKIQHPNVISLLGCSSNEDTRIIVYELMHNGSLETQLHGPSHGSALTWHLRIKIALDTARGLKYLHEHCYPPVIHRDLKSSNILLDTKFNAKLSDFGLAITNGSQNKNNLKLSGTLGYVAPEYLLDGKLTDKSDVYAFGVVLLELLLGKKPVEKLAQAQCQSIVTLAMPQLTDRSKLPNIVDPVIKNTMDPKHLYQVAAVAVLCVQPEPSYRPLIADVLHSLIPLVPVELGGTLKVSQLPKQVLPADPPEDSSQ

SEQ ID NO: 20662 - protein, 705 aa, GIBBERELLA ZEAE PH-1
MISYNARNQRIEAWVNAAAEESEDAAPVDPEARDLHDQEKAQRIEHEDLCRENKQTYRGVLLLWLAWQSAGVVYGDIGTSPLYVFSSTFTEQPSWHDLVGALSIIIWSLTLIVTVKYCFIVLSADDDGQGGTFALYSLLSRYANIARTDPNGPERIVVRLDRETGADLAPAGRIARDFLERSRVAQSVLKIVGVLGVSMVVADSILTPAQSVLGAVQGIQVIRPDLGRPAIVGISCAILVALFGLQFFGTSKIGTSFAPVVVVWLLYNLSISIYNLVQYDHTVLKAFSPHYAFTYLIRNETHGWKSLGGLLLAFTGVESLFADLGAFGKRAIQLSWLFLAFPCLLMTYCGQAAFISQDKTGLAYTNPFFRTVPENTLYFSIIIAVLAAVVASQALIVFVSYLIKTGLADSNLSDNKLRTRLWRVCDNCHLHHDLYALNKVPDGGWFALVLSFILSTFFMLWRWGKEQQWEAEQRDMVDPSEFVLSSRSTSRNNSIARGMSGDGSMRSIRFRLSPEFGGGQVQTAPGLGIFFDKVGGTGDHIPKVFTQFIRKFQTRPQVIVFFHMRSLSQPTVPSDQRFVIARVTTKIPSCYRIVLRHGYMDDILTPNLAPIIVNELMTFITRGPFPPDENDMPPEFRGELEALRAAEEAQTVYLMGKQTMRVQQAEKMGVTRFFRRIALEAFLWVRENSRTKLANLNINPDNLVE

SEQ ID NO: 20663 - protein, 229 aa, Nicotiana tabacum
MVEISPGFRFYPTEEELISFYLLNKLEGKRPELDRVIPVVTIYNLDPWHLPNLPGELCMGDTEQWFFFVPRQEREARGGRPCRTTTSGYWKATGSPTYVYSSESKVIGVKKSMVFYKGKAPTGRKTKWKMNEYRAIEQETSTSSSFSIPKLRHEMSLCRVYVISGSFRAFDRRPVATVTRDTAAVKIQELAGDRDNISSAISVKNESKSYNIVESDFENLNGWEQINWM

SEQ ID NO: 20664 - protein, 410 aa, Oryza sativa
  unsure (1)..(410): unsure at all Xaa locations
MWRLRVAEEAGAGGEGWLSSTNAHVGRQVWEFDAAAADDDDAAAAAEEVEAARREFTRRRHQIKHSADLLLLLQNVTESGRRHIQIRWLKIWVIFHPKPKKSTLVWIGLSQLTYLFIPTNPILKFTRSNPSKLEIPGIKLGEDEDVTEEAVLTSLKRAIRRYSTLQAHDGHWPGDYAGPMFLLPGLFYXVIVLHVTGALNTVLSTEHQKEIRRYXGVFDWSGNNPLLPELWMLPYFLPFHPGRIWSHCRMVYLPMSYIYGKKFVGPITPIVLTLRKELYNIPYDDINWDKARNQCAKEDLYYRHPLGQDILWATLYKFVEPVLSHWPGSKLREKALKNAMQHIHYEDENTRYICSGAVQKVLNMLSCWIENPNSEAFRFHIPRVHDYLWVAEDGMKMQVLISYLGLMAIF

SEQ ID NO: 20665 - protein, 340 aa, Micromonospora echinospora
MGGRMRALQFHGGHKAQIIDTPRPEAPPGWAVVKVHYCCLCGSDLWLYRGKWHGNRYPIVPGHEWAGVVDSAPEGYESWVGRPVTGDLIVGCQGCGPCRDGLPVMCENLIEIGFTVDGGCAGYVAVPITNLYLLPEGMDLAAASQTEPLAVALHAVDRINLRPAERVAVLGAGGIGQLILQSARATGATVTLATDLVAERRKIAEESGAAAAVHPSELPELTSYADKVDVVFEASGDPESVVRALDLVRPGGRVCLVGYQVGAEHALETARLPLSYASLVGVMGPGGKYREAVDLLANGAIDTQPILTDIVTLDDYAPAIDRAINRTDGTVRVVFDLRNE

SEQ ID NO: 20666 - protein, 340 aa, Oryza sativa (japonica cultivar-group)
MGSSQESTFSSASTAAQVNACALDLLPVYAKELIAGGAAGAFAKTAVAPLERVKILLQTRTHGFQSLGILQSLRKLWQYEGIRGFYKGNGASVLRIVPYAALHYMTYEQYRCWILNNFAPSVGTGPVVDLLAGSAAGGTAVLCTYPLDLARTKLAYQVSNVGQPGNALGNAGRQPAYGGIKDVFKTVYKEGGARALYRGVGPTLIGILPYAGLKFYIYEDLKSRVPEDYKRSVVLKLSCGALAGLFGQTLTYPLDVVRRQMQVQNKQPHNANDAFRIRGTFQGLALIIRCQGWRQLFAGLSLNYVKVVPSVAIGFTTYDMMKNLLRVPPRERLYQSSGNA

SEQ ID NO: 20667 - protein, 595 aa, Oryza sativa
  unsure (1)..(595): unsure at all Xaa locations
MKVIEKIQEAAADGRTVFSFEYFPPKTEEGLDNLFERMDRMVAHGPNFCDITWGAGGSTADLTLEIANRMQNMVCVETMMHLTCTNMPVEKIDDALTTIKSNGIQNVLALRGDPPHGQDKFVQVAGGFACALDLVQHIRAKYGDYFGITVAGYPEAHPDAIQSTEGATPEAYSNDLAYLKQKVDAGADLIITQLFYDTDIFLKFVNDCRQIGITCPIVPGIMPINNYKGFLRMTGFCKTKIPAEITAALEPIKDNEEAVKAYGIHLGTEMCKKILATGIKTLHLYTLNMEKSALGILMNLGLIEESKISRSLPWRPPTNVFRVKEDVRPIFWANRPKSYISRTLGWDQYPHGRWGDSRNPSYGALTDYQFTRPRGRGKKLQEEWAVPVKSVEDINERFMNFCQGKLTSSPWSELDGLQPETKIIDDQLVKINXQKGFLTINSQPAVNGERSDSTSVGWGGPXGGYVYQKAYLEFFCSKEKLDQLIEKSKAFPSLTYIAVNKDGESFSNIPTNAVNAVTWGVFPGKEIVQPTVVDSASFMVWKDEAFEIWSKGWACLFPEGDSSREILDKVHASPRVRPRVRQAAAAASGEGSRSF

SEQ ID NO: 20668 - protein, 393 aa, Zea mays
  unsure (1)..(393): unsure at all Xaa locations
GAXRRARLPPGEMGWPLVGGMWDFLRAXKSGXPDXFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFL

SEQ ID NO: 20669 - protein, 328 aa, Streptomyces coelicolor A3(2)
MELFVTIVSPHLGTSAEWTDARLLYALEEVVEQELNRHLKVAKDWMPHEYVPWTEARNFPGIFEDGEAWGKEQSKVTEIGRIALVVNLLTEDNLPSYHHEIASLFGRDGAWGTWVHRWTAEEGRHGIVMRDYLLASRAVDPDKLEQFRMAHMSEGFESDNRHSMLHSVAYVAFQELATRISHRNTGHQSGDPVCDRMLARIATDENLHMVFYRNLLKAAFELAPDLTMQAVRDVVVDFRMPGHGMPGFERAAAQMAIGEVYNLRIHHDDVIQPVLRFLKVMEIDGLGPEGQAAQEELGLYMGGLDAEAAKFDEKLAARKARMAARAAG

SEQ ID NO: 20670 - protein, 396 aa, Linum usitatissimum
MALKLNPVTTFPSTRSLNNFSSRSPRTFLMAASTFSSTSTKEAEAKEVTWTTKRGAYASDPFHAPTGSWEIFKSLGRLGLRDVLISHLKPVEKCWQPQDFLPEPESDGFEEQVKELRARAKELPDDYFVVLVGDMITEEALPTYQTMLNTLDGVRDETGASLTPWAIWTRAWTAEENRHGDLLNKYLYLSGRVDMRQIEKTIQYLIGSGMDPKTENNPYLGFIYTSFQERATFISHGNTARLAKDHGDMKLAQICGIIAADEKRHETAYTKIVEKLFEIDPDGTVLALADMMRKKISMPAHLMYDGEDDNLFDNYSSVAQRIGDTAKDYADILEFLVGRWKVDAFTGLSGEGNKAQDFVCGLPARIRKLEERAAGRAKQTSKSVPFSWIFSRELVL

SEQ ID NO: 20671 - protein, 457 aa, Shigella flexneri 2a str. 301
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 20672 - protein, 468 aa, Chorda filum
IPYPKMGYWDADYNVKDTDILALFRISPQPGVDPVETAAAVAGESSTATWTVVWTDLLTACDIYRAKAYRVDPVPGTSDQYFAYIAYECDLFEEGSLANLTASIIGNVFGFKAVKALRLEDMRIPYAYLKTLQGPATGIIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNTLLLTQLKINLAEGLFFDMDWASLRKCVPVASGGIHCGQMHQLLYYLGDDVVLQFGGGTIGHPDGIQSGATANRVALESMVLARNEGRDYFGEGPEILRNAASTCGPLKAALDLWKDITFDYTSTDTPDFVEQATESK

SEQ ID NO: 20673 - protein, 470 aa, Zea mays
PPPPFFPLPPRLHPFPSISSHLATPLPLSRADRLAHPSIEHGKKIPVRRGLNSIGLVLVWVGTMAATEASADKNAVFRKLRTKSDNKMCFDCNAKNPTWASVTYGVFLCIDCSAVHRSLGVHVSFVRSTNLDSWTPEQLKMMVYGGNNRAQAFFKQHGWTDGGKIEAKYTSRAADLYRQLLAKEVAKSATEDGNNSWPSSPVAASQASDQTAAFPDLKLTEVSKENVSEKEDSEIVRSPRVPTRSIKKPIGAKKPGNKTGGLGARKLTSKPNESLYEQKPEETAPVLPSSVIASTTARSKPHTSRFEYVENAPAPKTGSSSEGNLMSGHVAPPKSSNFFVEFGMDSGYHKKSTSSSSKVQIEESSEARQKFSNAKSISSSQFFGDQASFEKDTQVSLQKFSGSSAISSADLFGHPANNSSVDLSASDLINRISFQATQDLSSLKNMAGETGKRLTSMASNIITDLQDRIL

SEQ ID NO: 20674 - protein, 333 aa, Enterococcus faecalis V583
MTVKVGINGFGRIGRLAFRRIQDVEGIEVVAINDLTDAKMLAHLLKYDTTQGRFNGTVEVHEGSFNVNGKEIKVLANRNPEELPWGELGVDIVLECTGFFTSKEAAEKHLTAGAKRVVISAPGGNDVPTIVYNTNHETLTGEETVISGASCTTNCLAPMAKALHDNFGVVEGLMTTIHAYTGDQMTLDGPHPKGDFRRARAAAANIVPNSTGAAKAIGLVIPELNGKLDGAAQRVPVATGSLTELVTVLDKEVTVDEVNAVMEKAANESYGYNTDEIVSSDIVGMTYGSLFDATQTKVMTVGDKQLVKTVAWYDNEMSYTAQLVRTLEYFANL

SEQ ID NO: 20675 - protein, 377 aa, Zea mays
METPLSTRRITRSLAAASAQKIVAAGMDSAAIFSLSKNAAAGETHAQTRAALHDITNDSPVVGLATGSLHATDTTPAKTRRRAPRCTPGSGEALLRGQVKALLHKVDEEQGCAAAGALVRPKRIQALLGVSRSPAQLLAPTPANTPQIGPVSAPREGVGLHDGATVVPCVIDEEELLIPKLQVIAGSLPPPQPEEKLGECQLNRALVFDDSPDNSDESSGSAVPSSVSLQEGSAGKTSSPEEGDSSSAWSTQVHASSEKGDQEELDVEELAADYTEEEEDFEEEDDWEEDSDDGCYDDLCDVMSRMTVLDEGEKKTGLPQFEGKHTRFIYNSDDEIEREEVADAAEARAELGALMLRGLPVPEGRHLRFHDDEDDEE

SEQ ID NO: 20676 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAAAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 20677 - protein, 411 aa, Escherichia coli O157:H7 EDL933
  unsure (1)..(411): unsure at all Xaa locations
MEFTTGLMSLDTALNEMLSRVTPLTAQETLPLVQCFGRILASDVVSPLDVPGFDNSAMDGYAVRLADITSGQPLPVAGKSFAGQPYHGEWPAGTCIRIMTGAPVPEGCEAVVMQEQTEQTDNGVRFTAEVRSGQNIRRRGEDISAGAVVFPAGTRLTTAXLPVIASLGIAEVPVIRKVRVALFSTGDELQLPGQPLGDGQIYDTNRLAVHLMLEQLGCEVINLGIIRDDPHALRAAFIEADSQADVVISSGGVSVGEADYTKTILEELGEIAFWKLAIKPGKPFAFGKLSNSWFCGLPGNPVSATLTFYQLVQPLLAKLSGNTASGLPARQRVRTASRLKKTPGRLDFQRGVLHRNADGELEVTTTGHQGSHIFSSFSLGNCFIVLERDRGNVEVGEWVEVEPFNALFGGL

SEQ ID NO: 20678 - protein, 475 aa, Nienburgia andersoniana
DRYESGVIPYAKMGYWDPEYVIKETDVLALFRVSPQPGVDPVEASAAVAGESSTATWTVVGPDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAGTGEIKGHYMNVTAATMENMYERAEFAKQLGTVIIMIDLVIGYSAIQSMGIWARKNDMILHLHRAGNSTYSRQKIHGMNFRVICKWMRMAGVDHIHAGTVVGKLEGDPLMIRGFYNTLLLPNLEINLPQGIFFKQDWAALRKVTPVASGGIHCGQMHQLLDYLGNDVVLQFGGGTIGHPDGIQAGATANRVALESMVIARNEGRPYVQEGPEILRDAAKTCGPLQTALDLWKDITFNYTSTDTADFVESPTSNV

SEQ ID NO: 20679 - protein, 452 aa, Kallymenia rosea
ETDILALFRVSPQPGVDPIEASAAVAGESSTATWTVVWTDFLTACDLYRAKAYKVDSVPNASDQYFAYIAYDIDLFEEGSIANLTASIIGNVFGFKAVKALRLEDMRLPVAYLKTFQGPATGVIVERERMDKFGRPFLGATVKPKLGLSGKNYGRVVYEGLKGGLDFLKDDENINSQPFMRWTERYLYSMEGVNRSIAASGEVKGHYLNVTAATMEIMYERAAFAKQLGSIIIMIDLVIGYTAIQTMAIWARHNDMILHLHRAGNSTYSRQKIHGMNFRVICKWMRMAGVDHIHAGTVVGKLEGDPAMIRGFYNTLLLPHLDINLPQGIFFEQDWASLRKVTPVASGGIHCGQMHQLLDYLGVDVVLQFGGGTIGHPDGIQAGATANRVALESMVMARNEGRDYVAEGPQILQDAAKTCGPLQTALDLWKDITFNYTSTDTADFVETPTANV

SEQ ID NO: 20680 - protein, 364 aa, Streptomyces avermitilis MA-4680
MDVPVLHRLALNESPYPPLPSVRKAMRRAVAQAHRYPQFYPDDLTELIAAWCRVTPDRVVVGSGSVGVALQLLQAVVEHGDTMAYAWRTFDAYPLLAAMVGAHPVPVPLSPDGQQDLGALLAALDHRTRVVVLCNPHNPTGSLVTADDLSAFLRQVPPRVTVLLDEAYVEFARGPGLPDTPALLGAHPNLLVLRTFSKAYGLVALRVGYGLGAPDLVARIRRQQLPFGINAVATAAVRASLRADGELRLRVDTVVAERERLRHELVDLGWRVRPGHANSAWLDAPDPIDEGAAALTAAGVQARHYPGEGLRLTVGSRKANDAVLAALAGVGRHTASGRRASSAAPDGTVAAHRRPPVSGQRPDG

SEQ ID NO: 20681 - protein, 206 aa, Triticum aestivum
KKYVELSLADDWFVTEAMDVLVGWTKNLCFSKDLPGCSVLDIGTGSGRLLQQLAKQGFSDLTGIDYSEAAIELARNLAIRDGFEHINFLVDDVLESKLERRFELVMDEGTLDAIGLHPDGPVKRMMYWQSVASLVSPGGILVITSCSRTKDELVQEVENFNQRKLGATLSEGALASDAVVFKYLDHVQAYPNVDGVCIATVAFLHT

SEQ ID NO: 20682 - protein, 276 aa, Mycobacterium tuberculosis H37Rv
MSSFEGKVAVITGAGSGIGRALALNLSEKRAKLALSDVDTDGLAKTVRLAQALGAQVKSDRLDVAEREAVLAHADAVVAHFGTVHQVYNNAGIAYNGNVDKSEFKDIERIIDVDFWGVVNGTKAFLPHVIASGDGHIVNISSLFGLIAVPGQSAYNAAKFAVRGFTEALRQEMLVARHPVKVTCVHPGGIKTAVARNATVADGEDQQTFAEFFDRRLALHSPEMAAKTIVNGVAKGQARVVVGLEAKAVDVLARIMGSSYQRLVAAGVAKFFPWAK

SEQ ID NO: 20683 - protein, 492 aa, Brassica juncea
MDPYKYRPASSYNSPFFTTNFGAPVWNNNSSMTVGPRGPILLEDYHLVEKLANFDRERIPERVVHARGASAKGFFEVTHDISNLTCADFLRAPGVQTPVIVRFSTVIHERGSPETLRDPRGFAVKFYTREGNFDLVGNNFPVFFIRDGMKFPDMVHALKPNPKSHIQENWRVLDFFSHHPESLNMFTFLFDDIGIPQDYRHMEGSGVNTYMLINKSGKAHYVKFHWKPTCGVKSLLEEDAIRVGGTNHSHATQDLYDSIAAGNYPEWKLFVQIIDPADEDRFDFDPLDVTKTWPEDILPLQPVGRMVLNKNIDNFFAENEQLAFCPAIIVPGIHYSDDKLLQTRVFSYADTQRHRLGPNYLQLPVNAPKCAHHNNHHEGFMNFMHRDEEVNYFPSRYDPVRHAEKYPTPPAICSGKRERCIIEKENNFKEPGERYRSFTPERQERFIGRWIDALSDPRITHEIRSIWISYWSQADKSLGQKLANRLNVRPSI

SEQ ID NO: 20684 - protein, 923 aa, Oryza sativa
MEKDHQPVISLRPGGGGGGPRPGRLFSPAFAAAASGSGDLLRSHVGGASKIGDPNFEVRERVRYTRDQLLELREIVDIPEAILRINQEIDIELHGEDQIWGRPESDVQVQTQTQAQPHNRYGETDNRDWRARTVQPPAANEEKSWDNIREAKAAHASSGRQQEQVNRQDQLNHQFASKAQVGPTPALIKAEVPWSARRGNLSEKDRVLKTVKGILNKLTPEKFDLLKGQLMESGITTADILKDVISLIFEKAVFEPTFCPMYAQLCSDLNEKLPSFPSEEPGGKEITFKRVLLNNCQEAFEGAESLRAEIAKLTGPDQEMERRDKERIVKLRTLGNIRLIGELLKQKMVPEKIVHHIVQELLGSGPDKKACPEEENVEAICQFFNTIGKQLDENPKSRRINDTYFIQMKELTTNLQLAPRLRFMVRDVVDLRSNNWVPRREEIKAKTISEIHDEAMKTLGLRPGATGLTRNGRNAPGGPLSPGGFPMNRPGTGGMMPGMPGTPGMPGSRKMPGMPGLDNDNWEVPRSKSMPRGDSLRNQGPLLNKPSSINKPSSINSRLLPHGSGALIGKSALLGSGGPPSRPSSLMASLTHTPAQTAPSPKPVSAAPAVVPVTDKAAGSSHEMPAAVQKKTVSLLEEYFGIRILDEAQQCIEELQCPEYYSEIVKEAINLALDKGPNFIDPLVRLLEHLHAKKIFKTEDLKTGCLLYAALLEDIGIDLPLAPALFGEVVARLSLSCGLSFEVVEEILKAVEDTYFRKGIFDAVMKTMGGNSSGILKFVFPNRHYILLKLSNIGFVGRRGGGRVCWSRAASAAGALFARNMAGRHTIILMQPSQNRATRTFMDFNSVNHALDGICGLYERKIRDINPMARDLTYDINDLYNFIDGLTDISALVFDRSLHAFLPYDRRWIKQEMFQHLKRLAQQ

SEQ ID NO: 20685 - protein, 519 aa, Yarrowia lipolytica
MLTNLTIVLITLLVTYTVLTRTALRIQRARKAKQMGATLPPRVNNGILGWYGLWLVIQNARSMKLPHTLGKRFANGPTWLTPVAGNEPINTIDPENVKAILATQFKDFCLGIRHRALSPSIGDGIFTLDGEGWTHSRALLRPQFSRQQISRVHSLERLMQILFKLIRKENGEYFDLQNLFFMFTLDSATEFLYGASVDTLADLLGEPVEGDHGGVGEEVRKAYQQSINNAQDISAIRTRLQGLYWIAGNIYQRNLYQKSNKGVKDFSQFFVDKALNTSKEKLKEMEDSDNYVFLYELVKSTRNPVVIRDQLINILVAGRDTTASLLSFTFYTLGRRPDVLKKLRAAILEDFGTSPDEITFESLKRCDYLRYVLNEVLRLYPSVPINARSATRDTTLPRGGGPDGKQPVFVYKGQMVAYCVYWMHRDKKYWGEDALEFNPDRWDPKVQPQNKGWEYLPFNGGPRICLGQQFALTEAGYVVTRMLQEFDTVHCKNQKEEEHPPYALDLTMRHGEGVWVSMK

SEQ ID NO: 20686 - protein, 273 aa, Glycine max
MAEQALEGSQPVDLTKHPSGIVPTLQNIVSTVNLDCKLELKSIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQWYGSGSFSIAIGYTCCNPWARNIMNQYHCLYYFFFFVQLSEYNCVRCRAEVFLIEMTKFFTQFLFWVIYLYKF

SEQ ID NO: 20687 - protein, 365 aa, Synechococcus sp. PCC 7942
MTVVIYYMTVLCKAFDCFNSSAVENTMIRIRNRWFRWLAIALASLVASIGIATVGFAATGVTPDQVLSAIEGTFGVNVGQRRNHIKGTCAVGNFVATTEAKTYSRSPLFSGQSIPVVARFSLAGGNPKAPDTAKNPRGLGLQFQLPNNRFLNMALLNTPVFGVASPEGFYENILAIRPDPTTGKPDPEKVKAFREKYPENKAQAAFLASNNPPTSYANTSYFGLHAFKFINQTNQTRLVRWQFVPQDGEKRLTDAELQAAPANFLEQKLIERTQDSPVKWDFWITLGQPGDAEDNPTIAWPSDRQQVKVGTLTLTAASPQPGAACEGINYDPLVLSDGIEPTNDPVLQFRSGVYALSYSKRTRGL

SEQ ID NO: 20688 - protein, 558 aa, Shigella flexneri 2a str. 301
MSAAFSTISVILARKFVIAVVKLLPTGEDFASHVYPCYTSHRKETIMTNNPPSAQIKPGEYGFPIKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 20689 - protein, 492 aa, Oryza sativa
MDPYKHRASSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPGFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 20690 - protein, 518 aa, Saccharum hybrid cultivar H65-7052
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 20691 - protein, 242 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPTDGAAHQCESLRSSSRKLRSDQVAAPAHRSQPTTGLTMVLHASSIELSHYLQFLLKFVLLAYAVLCLTELLHRWSNGSVLSLWSA

SEQ ID NO: 20692 - protein, 341 aa, Populus deltoides
MGSLETERKIVGWAATDSTGHLAPYTYSLRDTGPEDVFIKVISCGVCHTDIHQIKNDLGMSHYPMVPGHEVVGEVVEVGSDVTRFKVGDVVGVGVIVGSCKNCHPCKSEIEQYCNKKIWSYNDVYTDGKPTQGGFAESMVVHQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGVASMIEVIKMDYINTHSRGLRKMM

SEQ ID NO: 20693 - protein, 738 aa, Pyrobaculum aerophilum str. IM2
MSTEVILKVAEARSRDVGRSIVRLPVRIMKKLGIEPGDYVEIIGRKSAYAQVWPAYPEDEDKEVIRMDGIIRQNAGVGIGDTVKVRKAVLKPAQRVVLTPTEPVRVDSEYLKKQILLGKPVARGQAIDVPFYGGAIRFVVVQVQPGPAAYVSIDTEVTVREEPVKEAELTIPRVTWEDIGDLEDAKQKIRELVELPLRHPELFKHLGIEPPKGILLIGPPGTGKTLLAKAVANEANAYFVAINGPEIMSKYYGESEARLREIFEEAKKNAPAIIFIDEIDAIAPKREEVTGEVEKRVVAQLLTLMDGLQERGQVIVIGATNRPDAVDPALRRPGRFDREIHIPMPDKRARREILAVHTRNMPLCTKADVETKICNPGDEVDLDRIAEMTHGYTGADLAALAKEAAMTALRKAMNKGMINIEQDIIPQEVLSKLKVGMSDFLEAMKFVHPTVLREVIIEVPEVHWDDIGGYDTIKQELREIVEWPMKYKHYFDELGVEPPKGILLFGPPGVGKTLFAKAVATESGANFIAVRGPELLSKWVGESEKAIREVFKKARMAAPCVIFFDEIDSIAPARGSRLGDSGVTDRMVNQLLAEMDGIGTLKNVVVMAATNRPDILDPALLRPGRFDRVIYVPPPDLKARIEIFKVHTKRVKLADDVNLEELAKRTEGYTGADIAALVREAAMLALRETIREKTVKAKPVSMKHFEEALKRIPPSLTPEDIRRYEEIAKRLRRAIAGL

SEQ ID NO: 20694 - protein, 442 aa, ASPERGILLUS NIDULANS FGSC A4
MALSYADAVWLVKTEAQRHASLQRERCSIYSACDRVAAERITSPISTPEYDTSAMDGFALSSTATETASPETPVTFNVMATTTAGDRPYPAADSLRDAKDSIPPCVEIMTGAPFPTGQEWERFDCSVPIEEVVVQEDRCPPSQRRYVSVCKPARRWQHRRFAGGDFTQGDRIIEAGDCIQPQHIMAMASVGLREIPVLRRPRIAVFSTGSELMSDASKAHQFMIYDANGPYLTSILRQWGFDVVFRGVLQDDSAAMEESIVRALDYGYDMIVTSGAVSAGRCDIIPGLVKRIGGRTVFHKVAVKPGHPILFAMLPPPRETGETAFFGLPGNTVAAAACLRFFALPYLRTLQRQSPEEPKAAALRLSNGETEPCNGAAGKVLTFREAPDIFRPAISTQSGQVWIIDDHSPGKTRPFLQANCWAHIPSGVSEMRAGSRVDIYPL

SEQ ID NO: 20695 - protein, 479 aa, Mesembryanthemum crystallinum
RKLHDADVSEEDQNNLLKFLEKKETEYMRLQRHKMGADDFELLTMIGKGAFGEVRVCREKTTGHVYAMKKLKKSEMLRRGQVEHVKAERNLLAEVDSNCIVKLYCSFQDEEYLYLIMEYLPGGDMMTLLMRKDTLTEDEARFYVAETILAIESIHKHNYIHRDIKPDNLLLDKFGHLRLSDFGLCKPLDCSTLEEKDFEVNNGNGGSPSNEGSTKPRRTQQEQLQHWQKNRRMLAYSTVGTPDYIAPEVLLKKGYGMECDWWSLGAIMYEMLVGYPPFYSDDPMSTCRKIVNWRTHLKFPEEAKLSPEAKDLISKLLCNVTQRLGSNGAHEIKLHPWFNGIDWERIYQMEAAFIPEVNDELDTQNFEKFEEADNSSQSTSKAGPWRKMLSSKDLNFVGYTYKNFEIVNDYQVPGIAELKKKDTKPKRPSIKSLFEDESSDSSEAATSGDQSVQGSFLNLLPPQLEVSQTQTEVPPPKFT

SEQ ID NO: 20696 - protein, 161 aa, Narcissus pseudonarcissus
LKKGSSTDQDVEVYRGEEFDDDGRPRRTGTVWTASAHIITAVIGSGVLSLAWSMSQLGWIAGSVTLFLFSIVTFFTSSLLTDCYRSPDPVHGKRNYTYMSAVKSNLGSTKVWFCGICQYVILVGTAIGYTITASISAAAISKSGCFHKKGHEADCAVSDSL

SEQ ID NO: 20697 - protein, 314 aa, Mastigocladus laminosus
NGFGRIGSNFMRCWLGRENSNIDLVAINDTSDPRTNAHLLKYDSMLGKLKNADITADDNSIIANGKTVKCVSDRNPENLPWKEWEIDLIIEATGVFTAKEGAMKHVNAGAKKVLITAPGKNEDGTFVIGVNHHDYDHDKHHIVSNASCTTNCLAPIAKVLHEKFGIIKGTMTTTHSYTGDQRLLDASHRDVRRARAAAINIVPTSTGAAKAVALVLPDLKGKLNGVALRVPTPNVSMVDFVIQVEKPTIAEEVNAALKSASENELKGILDYSELQLVSSDYQGTDASSIIDASLTLVMGGDMVKVMAWYDNEWG

SEQ ID NO: 20698 - protein, 426 aa, Helicobacter pylori J99 [sequence omitted]

SEQ ID NO: 20699 - protein, 214 aa, Ranunculus bulbosus
  unsure (1)..(214): unsure at all Xaa locations
KAHEISVLCDADVALXIFSIKGKLXEYSTNDXMEGILERYXRYSXTSTELVAADPESQECLSMEYNKLKSKAEALQRSQRHFMGEDIGGLCVKELQALEQQLDTSSRQIRSRKNQLMAGSIIELQKNEKALLEENINLKKQAKEKELALSLCEQLNPVERSPYVPLPDXVPALNTNGPTNQSSGSGGXGGGGEEVVAQPPQTKTPMPPWMLXHL

SEQ ID NO: 20700 - protein, 249 aa, Zea mays
MFGYQKGLDVEAGTSGAAATGGARQLYPGMQESPELRWALIRKIYVILSLQLLLTAVVAAVVVKVRAIPHFFTTTSAGLGLYIFLIILPFIVLCPLYFYHEKHPVNLILLGLFTVAISFAVGMTCAFTSGKVILESAILTTVVVLSLTAYTFWAVNRGKDFSFLGPFLFAAIIVLLVFALIQILFPLGKLSQMIYGGLASLIFSGYIVYDTNNIIKRYTYDQYVWAAVSLYLDVINLFLSLMTLFRAAD

SEQ ID NO: 20701 - protein, 525 aa, Hordeum vulgare
MATEQLNVLKALDVAKTQLYHFKAVVIAGMGFFTDAYDLFCIALVTKLLGRIYYTDPALNEPGHLPANVSAAVNGVALCGTLAGQLFFGWLGDKLGRKSVYGFTLILMVLCSIASGLSFGHEAKGVMGTLCFFRFWLGFGVGGDNPLSATIMSEYANKKTRGTFIAAVFAMQGFGILFGTIVTIIVSSAFRHAFPAPPFYIDAAASIGPEADYVWRIIVMFGTIPAALTYYWRMKMPETARYTALIAGNTKQATSDMSKVLNKEISEEAAQGERATGDTWGLFSRQFMKRHGVHLLATTSTWFLLDVAFYSQNLFQKDIFTKIGWIPPAKTMNALEELYRIARAQALIALCGTVPGYWFTVAFIDIIGRFWIQLMGFTMMTIFMLAIAIPYDYLVKPGHHTGFVVLYGLTFFFANFGPNSTTFIVPAEIFPARLRSTCHGISAATGKAGAIIGAFGFLYASQDQRKPETGYSRGIGMRNALFVLAGTNFLGLLFSLLVPESKGKSLEELSKENVGDDDAIAPTGV

SEQ ID NO: 20702 - protein, 157 aa, Glycine max
FWSHAVKLGPKITDTVKGKLSLGARILQVGGVEKVFMQLFSVKDGGEKLLKACQCYISTTSGPLAGLLFISTDKVAFCSDRSIKAYSSKGHLIRIHYKVVIPLEKIRSINQSQHVKKPSQKYIEIVTVDNFDFWFMGFLNYQKAFKYLKQAISQAQA

SEQ ID NO: 20703 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 20704 - protein, 519 aa, Candida maltosa
MVFTAFILEYWYFTLLSLAAGHFIGKHVYTNYLMRKHHAEPILDVVDDGAFGFKFGFQALKAKKIGKQIDLLFKKFNEAKHPSIGTFVTRSFGMQFIATKDPENIKAMLATQFNDFTLGQRLSYFAPLLGKGIFTLDGEGWKHSRAMLRPQFSRDQVGHVKMLEPHFQLLKKHIIKNKGSFFDIQELFFRFTVDSATEFLFGESVSSLKDESIGYDQEEIDFAGRKDFAEAFNKSQVYLSTRSLLQLLYWLVNSSDFKRCNKIVHKFSDYYIKKALTATPEELEKHSSYIFLYELAKQTRDPIVLRDQSLNILLAGRDTTAGLLSFAVFELGRNPEVWSKLREEIGDKFGLDPDSRIEDISFELLKLCEYLKAVINETLRLYPSVPRNGRFAAANTTLPHGGGPDGMSPILVRKGQTVMYSVYALQRDEKYYGKDANEFRPERWFEPEVRKLGWAFLPFNGGPRICLGQQFALTEASYVLVRLIQSFETLELSPDAPYPPAKLTHLTMCLFDGAPVRIE

SEQ ID NO: 20705 - protein, 242 aa, Nicotiana sylvestris
MGRGKVQLRRIENKINRQVTFSKRRGGLVKKALEISVLCDAEVALIVFSHKGKIFEYSSDSCMEQILERYERYSYTERRLLASNSESSVQENWSLEYAKLKAKIDLQQRNHKHYMGEDLDSLSLKDLQNLEQQLDTSLKLIRSRKNQLMHESISMLQKKEKAIQEENNMLSKKIKEKDNTVGQQVEWHQQNQVPTSASFLLQPHPCLNIGGNYQEEREERRRNELDLNLDSLYPCHMGCFAT

SEQ ID NO: 20706 - protein, 478 aa, Lactobacillus sakei
MTNQLTTNEGQPWADNQHSQTAGQRGPVLIQDYQLLEKLAHFNRERIPERVVHAKGAGAKGYFKVTKDMSAYTKAAVFSGVGKKTPLITRFSQVAGEAGYPDTYRDVRGFAVKFYTEEGNYDIVGNNTPVFFVNDPLKFPDFIHSQKRDPRTHARSQDMQWDFWSLSPESVHQVTILMSDRGIPASYRMMHGFGSHTFKWVNAQGEQFWVKYHFKTNQGIHNLSNELADELAGKDTDYLQNDLFDAIETGDYPSWTVAVQLVPYEDGLNYPQDIFDVTKVISQKDYPLIEIGQMVLDENPTNNFEDIQELAFSPANLVPGIEASPDKLLQGRLFGYKDAERYRLGANYEQLPVNRPKVPVHNYERDGAMAQNQATGVNYEPNSQDGPTEVPAAKIHGDQLSGTTGNFSADPDYYSAAGKLYRLLSADEQTRLIENIRMNLGQVTKPEIQIREVKQFYQADPEYGRRVATSVKLRFSSV

SEQ ID NO: 20707 - protein, 455 aa, Nostoc sp. PCC 7120
MAIATINPATGETLKTFEPLNDVEIAAKLDLADQAFEKYRHTSFAERSQALQAAANILEQEKADFAKLMTLEMGKPYKAAIAEVEKCAAVCRYYAENAADFLADVSVKTDASHSFVRYQPLGIILAVMPWNFPFWQVFRFAAPALMAGNVGLLKHASNVPQCALAIEDIIHRAGFPKGVFQTLLIGAAKVADLIADERVKAATLTGSEPAGASLAAAAGKQIKKTVLELGGSDPFIVLESADVEAAAATATSARMLNNGQSCIAAKRFIVAEAIADQFEKLLLEKFTALKIGDPLHPDTDLGPLATPDILQDLDQQVQTAVKSGGKVLTGGYPLADRPGNFYPATIIIDIPVDQPIAQEEFFGPVALLFRVPDIDTAIQLANATPFGLGASAWTNNDQERDRLISEIEAGAVFINGLVKSDPRLPFGGIKRSGYGRELSIQGIHEFVNVKTVWVK

SEQ ID NO: 20708 - protein, 207 aa, Orobanche minor
KGGAKKVVISAPSKDAPMFVVGVNEKEYKKDIDIVSNASCTTNCLAPLAKVLNDRFGIVEGLMTTVHSITATQKTVDGPSMKDWRGGRAASFNIIPSSTGAAKAVGKVLPALNGKLTGMAFRVPTVDVSVVDLTARLEKAASYDEIKAAIKEESETNLKGILGYTEDDVVSTDFVGDCRSSIFDAKAGIALNGNFVKVVSWYDNEWG

SEQ ID NO: 20709 - protein, 479 aa, Schizoseris multinervis
RLKNDRYESGVIPYAKMGYWDPDYVIKETDVLALFRVSPQPGVDPVEASAAVAGESSTATWTVVWTDLLTACDLYRAKAYKVDPVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAASGEIKGHYMNVTAATMEEMYERAEFAKQLGTVIVMIDLVIGYTAIQSMGIWARKNDMILHLHRAGNSTYSRQKIHGMNFRVICKWMRMAGVDHIHAGTVVGKLEGDPKMIKGFYDTLLKPFLDINLPEGIFFTQDWASLRKVTPVASGGIHCGQMHQLLDYLGNDVVLQFGGGTIGHPDGIQAGATANRVALECMVIARNEGRDYVTEGPQILRDAAKTCGSLQTALDLWKDITFNYTSTDTADFVETPTANV

SEQ ID NO: 20710 - protein, 394 aa, Zea mays subsp. mays
  unsure (1)..(394): unsure at all Xaa locations
LGSARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDRTVTSSLRAWADHGASVEFLTEIRRMTFKIIVQIFLXGADQATTRALERSYTELNYRMRTMAIHMTDFAYRGALRARRRIVTVMQGVLDERRAARAKGVSGGGVDMMDRLIEAQDERGRRLDDDEIIDVLVMYLNAGHESSGHITMWATVFLQENPDMFARAKAEQEAIMRSILSSQRGLTLRDFSKMEYLSQVIDETLRLVNISFVSFRQATRDVFVHGYLIPKGWKVQLWYRSVHMDPQVYPDPTKLYPSRWEGHSPRPGTFL

SEQ ID NO: 20711 - protein, 178 aa, Zea mays
  unsure (1)..(178): unsure at all Xaa locations
MGEERAAPKPGPAAATAVELTGFVMGAEEAERAAAAAGVATVQDLLPLLVPSAMERARAPISRFRVGAVGLGASGRVYAGVNLEFRGLPLCHSVHAEQFLVANAAAAGEPALRAVAVSHMPCGHCRQFLQEMRGAAAVQILVTSDAAEXRAPEWRALASLLPGPFGPXDLLPQDVALP

SEQ ID NO: 20712 - protein, 213 aa, Zea mays
  unsure (1)..(213): unsure at all Xaa locations
MDDEEHEVYGQEIPEDGDMDGADVDMAAAGDDAAKLQELDEMKRKLKEMEEEAAALRDMQAKVAKEMQGGDPSISTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGLWGXAPRFRRPMRYRPYF

SEQ ID NO: 20713 - protein, 159 aa, Frankia sp. FE1
ITKEQYSRDPRNIAKKAEAYLRGTGIADTAYFGPEAEFYIFDDVRYDYTPYGSMHAVDSVEAAWNTARKEEGGNLGYKPRFKGGYFPVPPTDHFTDLRSEMTRVLFEVGITVEMQHHEVGTAGQAEIDIRYDTLLKTADNLMLYKYVIRNVARSRGKTV

SEQ ID NO: 20714 - protein, 517 aa, Candida tropicalis
MYEQVVEYWYVVLPLVFILHKVFDMWHTRRLMKQLGAAPVTNQLHDNFFGIINGWKHLSSRKKVELKNIMIINLPIRKFQVWVHMLVPSLEQSSSSQKIRRNIKALLATQFSDFSLGKRHTLFKPLLGDGIFTLDGQGWKHSRAMLRPQFAREQVAHVTSLEPHFQLLKKHMVKNKGGFFDIQELFFRFTVDSATEFLFGESVHSLKDETIGSYQDDIDFVGRKDFAESFNKAQEYLAIRTLVQDFYYLVNNQEFRDCNKLVHKFTNYYVQRALDATPEELEKQSGYVFLYELVKQTRGPNVLRDQSLNILLAGRDTSAGLLSFAVFELARNPHIWAKLREDVESQFGLGEQSRIEEITFESLKRCGYLKAFLNETLRVYPSVPRNFRIATKNTTLPRGGGSDGNSPVLVKKGEAVSYGINSTHLDPVYYGDDAAEFRPERWNEPSTRKLGWAYLPFNGGPRICLGQQFALTEAGYVLVRLAQSFDTLELKPPVVYPPKRLTNLTMSLQDGTIVKID

SEQ ID NO: 20715 - protein, 90 aa, Argemone mexicana
  unsure (1)..(90): unsure at all Xaa locations
REQDRYMPIANVIRIMRKVLPTHAKISDDAKETIQECVSEYISFITSEANDRCQREQRKTITAEDVLWAMSKLGXDEYIEPLTLYLQRYR

SEQ ID NO: 20716 - protein, 258 aa, Zea mays
  unsure (1)..(258): unsure at all Xaa locations
DSARAPERCYPQPRRARPPPQPRRSRARPASTPRGADIAPSMLSSVFANLAFKVERMVRLCYDCLHMDFMNVHFVPNLTIGDTVIQSLRKHXTKAYLHCHLMVTKPSDYVEPFGKAGASGFTFHIEVARDNWQDLIQSIKSKGMRPGVSLSXGTPVEEVFPLVEAENPVELVLVTTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 20717 - protein, 335 aa, Zea mays; identical to SEQ ID NO: 12168

SEQ ID NO: 20718 - protein, 131 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEA

SEQ ID NO: 20719 - protein, 283 aa, Oryza sativa
MSGRRSFFASKKPSRSSNPFDSDSDDGGREQRPARASSVPPPADQRGSLFGGGDGFSASSAAARSRYRNDFRDTGGVEAQSVQELEGYAAYKAEETTQRVQGCVRIAEEMRDTASKSLVTIHQQGQQITRTHMMTLDIDQDLSRSEKLLGDLGGIFSKKWKPKKNGEIRGPMLTRDDSFIRKGSHLEQRHKLGLSDHPPQSNARQFHSEPTSALQKVEMEKAKQDDGLSDLSNILTELKGMAVDMGTEIDRQTKALGDSEKDYDELNFRIKGANTRARRLLGK

SEQ ID NO: 20720 - protein, 375 aa, Oryza sativa; identical to SEQ ID NO: 4639

SEQ ID NO: 20721 - protein, 122 aa, Salmonella enterica
MSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMD

SEQ ID NO: 20722 - protein, 462 aa, Glycine max
  unsure (1)..(462): unsure at all Xaa locations
MATATLSPADADKLSNLKSSVAALSQISENEKNGFTSLVARYLSGEAQHVEWSKIETPTDEVVVPYDSLAPTPDGSLEVKNLLDKLVVLKLNGGLGTTMGCTGPKSVIEVRDGLTFLDLIVVQIENLNSKYGSNVPLLLMNSFNTHDDTQKIVEKYKNSNIEIHTFNQSQYPRLVVDDFLPFPSKGHTDKDGWYPPGHGDVFPSLLNSGKLDALLSQGKEYVFVANSDNLGAIADLKILNHLIQNKNEYCMEVTPKTLADVKGGTLISYEGRVQLLEIAQVPDEHVNEFKSIEKFKIFNTNNLWVNLNAVKRLVEADALKMEIIPNPKEVDGIKVLQLETAAGAAIRFFDKAIGINVPRSRFLPVKATSDLLLVQSDLYTLEDGFVIRNKARANPENPSIELGPEFKKVSNFLGRFKSIPSIVELDSLKVAGNVWFGAGVILKGKXSIVANPGVKLGVPDGA

SEQ ID NO: 20723 - protein, 309 aa, Methanothermobacter thermautotrophicus str. Delta H
MSEDRDLLAVGHTAFDYIIHLDEFPEPNTSTAIKRMRNLHGGAAANVALVGSRLGLRTSLVSAVGGDFEGSEYRELLESSGIDIESMILVADESTPTAFVMTDSDHNQISYFYWGAARYFKDAETPADAIKSARAVHLATGDPSFNCRCGEFARSLGKIISFDPGQDLHMYSRSQLERAVGVCDILFGNHHEIDRICSKLSVDIHGLREMGPGVVVKTYGKEGSIIYSDDVIKIDAIPREAVDPTGAGDSYRAGFMRAYLRGADLKTCGRFASAVASFIVEDEGTQTNIPDTGEAVKRFTAQWGYEPPI

SEQ ID NO: 20724 - protein, 187 aa, Saccharomyces cerevisiae
MPIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 20725 - protein, 295 aa, Burkholderia pseudomallei
MLKVTKAVFPVAGLGTRFLPATKASPKEMLPVVDKPLIQYAVAEAINAGITEMIFVTGRSKRAIEDHFDKSFEIESELEARGKEKLLELVRGIKPSHVDCFYVRQPAALGLGHAVLCAEKLVHGEPFAVILADDLLHGDQPVLKQLVDVFNHYHSSVIGVETIEREDSRSYGIVEGREWEEDIIKLSGIIEKPAPEHAPSNLGVVGRYVLMPSIFEHLLQIKRGAGGELQLTDAVQSLLTEEQVLAYRYYGTRFDCGSKLGYLKATVELALRHPEVGREFEAYLRNCLPALAAVA

SEQ ID NO: 20726 - protein, 348 aa, Erwinia chrysanthemi
MERWFKSLFIIAFFFISTANAADKLPNIVILATGGTIAGSAATGTQTTGYKAGALGVDTLINAVPEVKKLANVKGEQFANMASENMTGDVVLKLSQRVNALLARDDVDGVVITHGTDTLEESAYFLHLTVKSDKPVVFAAAMRPATAISADGPMNLLEAVRVASDKQSRGRGVLVVLNDRIGSARYITKSNASTLDSFRANEEGYLGVVIGNHIYYQNRLDKLHTNRSVFDVRGLASLPKVDILYGYQDDSEYLYDAAISHGVKGIVYAGMGAGSVSVRGIAGMRKAQDKGVVVMRSSRTGNGIVPPDEALPGLVADSLNPAHARILLMLALTRTSDPAVIQDYFHTY

SEQ ID NO: 20727 - protein, 295 aa, Panax ginseng
MTYMFKYDTVHGQWKHHELKVKDNNTLLFGEKPVKVFGIGNPEEIPWGEAGADFVVESTGVFTDKDKAAAHLKGGAKKVVISAPSKDAPMFVVGVNEKEYTPDLHIVSSASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLAKKASYDEIKAAIKEESEGKLKGILGYTEDDVVSTDFLGDSRSSIFDAKAGIALNENFVKLVTWYDNEWGYSSRVVDLVVHMASVQ

SEQ ID NO: 20728 - protein, 536 aa, Deinococcus radiodurans
MSDENNKGVGTAVQGVGGPRDGRTAPGEQGTTLTTRQGHPVHDNQNSRTVGSRGPMTLENYQFIEKLSHFDRERIPERVVHARGVGAHGVFRATGKVGDEPVSKYTRAKLFQEDGKETPVFVRFSTVGHGTHSPETLRDPRGFAVKFYTEDANWDFVVNNLKIFFIRDALKFPDLIHSQKPSPTTNIQSQERIFDFFAGSPEATHMITLLYSPWGIPASYRFMQGSGVNTYKWVNDQGEGVLVKYHWEPVQGVRNLTQMQADEVQATNFNHATQDLRDAIERGDFPQWDLFVKIMEDGEHPELDFDPLDDTKIWPREQFPWRHVGQMTLNRNPENVFAETEQAAFGTGVLVDGLDFSDDKMLQGRTFSYSDTQRYRVGPNYLQLPINAPKKHVATNQRDGQMAYRVDTFEGQDQRVNYEPSLLSGPKEAPRRAPEHTPRVEGNLVRAAIERPNPFGQAGMQYRNFADWERDELVSNLSGALAGVDKRIQDKMLEYFTAADADYGQRVREGIQAKEAEMKGQKQEAPVYGTEASSLY

SEQ ID NO: 20729 - protein, 480 aa, Desulfovibrio vulgaris
MTKHKLTTNAGAPVPDNQNAMTAGPRGPMLLQDVWFLEKLAHFDREVIPERRMHAKGSGAYGTFTVTHDITSYTKAALFSKIGKKTDLFVRFSTVAGERGAATAERDIRGFAIKFYTEQGNWDLVGNNTPVFFLRDPLKFPDLNHAVKRDPRTNMRSAKNNWDFWTSLPEALHQVTVVMSDRGIPASYRHMHGFGSHTFSFISPDNQRYWVKFHLRTQQGIKNLTDAEAEAIVARDRESHQRDLYDSIERGDFPRWTNYVQVMPEKDAEKLPYHPFDLTKVWFHKDCPLIEVGVLELNRNPENYFAEVEQAAFNPANVVPGISFSPDKMLQGRLFSYGDAHRYRLGVNHHLIPVNAARCPVHSYHRDGAMRVDGNHGSTLAYEPNSYGEWQEQPDFAEPPLAIRGDAAHWNFREDDADYYDQPGRLFRLMTPQQQDELFQNTARAMGDAPEEIKRRHVGNCAKADPAYGAGVARALGLKM

SEQ ID NO: 20730 - protein, 500 aa, Triticum aestivum; identical to SEQ ID NO: 3351

SEQ ID NO: 20731 - protein, 148 aa, Mesembryanthemum crystallinum
GTAPFYLRHLPSSNIAEVPDLDDEYRSVMKEFALRLEKLAEEILDLFCENLGLEKGYLKKVFYGDKAPNFGTKVSNYPPCPKPDLIKGLRAHTDAGGVILLFQDDRVSGLQLLKDGEWIDVPPMRHSIVVNLGDQLEVITNGKYKSVM

SEQ ID NO: 20732 - protein, 242 aa, Euphorbia esula
TTIFSPEGRLYQVEYAMEAIGNAGTAIGILSKDGVVLVGEKKVTSKLLQTSTSTEKMYKIDDHVSCAVAGIMSDANILINTARVQAQRYYFSYQEPMPVEQLVQSLCDTKQGYTQFGGLRPFGVSFIFAGWDKNFGFQLYTSDPSGNYGGWKAAAIGANNQAAQFMLKQDYKDEITREEAVQLALKVLSKTMDSTSLTSDKLELAEVFLLPSGKVKYQVCSPETVSKLLVQYGVTQPSADAS

SEQ ID NO: 20733 - protein, 414 aa, Chondrus crispus
MAFVAPVATVRATTKSSVCQVQGRSSFAQFSGMKKVNQSSRLQPAQSGSAFGGYSDANDAFYTRVSGIVAATFGPTMKVRVAINGFGRIGRNFIRCWAGRSDSNMEVVCINDTSGVKTASHLLKYDSILGTFDADVSAGEDTISVNGKTIKIVSNRNPLQLPWKEMNIDIVVEATGVFVDAPGAGKHIEAGAKKVLITAPGKGDGIGTFVVGVNEKDYSHDKYDIVSNASCTTNCMAPFMKVLDDEFGVVRGMMTTTHSYTGDQRLLDAGHRDLRRARSAALNIVPTTTGAAKAVALVVPSLKGKLNGIALRVPTPNVSVCDVVMQVNKKTFKEEVNGALLKASEGAMKGIIKYSDEPLVSCDHRGTDESTIIDSSLTMVMGDDMIKVVAWYDNEWGYSQRVVDLGEVMARQWK

SEQ ID NO: 20734 - protein, 375 aa, Saccharomyces cerevisiae [sequence omitted]

SEQ ID NO: 20735 - protein, 248 aa, Zea mays
MGRQFFVGGNFKMNGTIKSITEIVDNLNKAKLDENTEVVIAPPSLYLLLTREHLRKGIEVAAQNIFDKPNGAFTGEISVEQLKDSGITWTILGHSERRQILQENDDFVASKTKAAVDGGLGVILCCGESLEQREAGETVNVVTKQLKAVADKVKDWSKIVVAYEPIWAIGTGKVATTEQAQEVHAALREWLKKEVSAEASEKTRILYGGSVSEKNCKELAKRPDIDGFLVGGASLKPAFVDIINSHQA

SEQ ID NO: 20736 - protein, 96 aa, Zea diploperennis
MGRRACCEKEGVKRGAWTTKEDDALAAYVKAHGEGKWREVPQKAGLRRCGKSCRLRWLNYLRPNIRRGNISYDEEDLIIRLHRLLGNRWSLIAGRL

SEQ ID NO: 20737 - protein, 639 aa, Trichodesmium erythraeum IMS101
MNNFFGLDVKDLVELAKTLEEKAKSGEIKTSFEVQSGPMRNIPRHGNIPRGMGRSNYQAQTGQSSQDTNFTVQSPNKDSVTQNRAQEKTNSTTSSPETKLRPTLRDIGGMSEVIQELREVIELPLKRPDLLTKLGLEPSRGVLLVGPPGTGKTLTAKAIAEELGLNYIAINGPEVMSKYYGEAEGKLRDIFAKAKKSAPCLIFIDEIDSIAPDRSKVEGEVEKRLVAQLLGLMDGFEVLEGVLLLAATNRPDHIDPALRRPGRFDQEVYFHVPDRDGRSEILQILTKAMPLDNSVDLEEIADLAVGLVGADLKAVCQKAAYFALRREVPSLENLNIQTPEDMSLLQSDLLRAIKEIKPSILRSVAVEVPNVSWQHIGGLDVVKQKLQESVEGALLYPELYEKTKAKAPKGILLWGEPGTGKTLLAKAVASQAQANFIAVNGPELLSKWVGAAEEAVRELFSKARQVSPCVIFIDEIDTLAPARGKTMGDSGVSDRLVGQLLTELDGLRDCTQLLLVGATNRPDALDPALLRAGRLDLQIKVDLPDQASRLEILKVHNQDRPLEEVNLEDWASRTEGWNGADLALLTNQAALAAIRSYSAQGIKSSKENDIKITSADFENAYNALKSQKQSNNFDSDICV

SEQ ID NO: 20738 - protein, 1092 aa, Arabidopsis thaliana
MAEENRKDRGVSSTVAIPSGLNRIKTRLASSGPRPEDSSDTVLKPPFNRNQKTIVPRGHGRTTGSSKQERKGTKLSRWLASYKPKYSCHPPKYACSSTTSSEEIKLRGKNSGKDEEKMIKISETNPPCSKSMGIKSFSHELGPRGGVQTPYPRPHSYNDLKELLGSLHSRFDVAKETVDKKLDVFVRDVKEAMEKMDPSCPEDREMAEQLLDVARACMEMTSAQLRATCESIVQDLTRKRKQCQAGLVKWLFSQLLFILTHCTRVVMFQKETEPIDESSFRKFKECLERIPALETDWGSTPRVDDSGSGYPEYQRNEAGQKFKRRDKESLESETALDYVVPNDHGNNAAREGYAAAKQEFPSHEPQFDSKVVEQRFYLSDEYEDKMSNEPGKELGGSDYVICRICEEEVPLFHLEPHSYICAYADKCEINCVDVDERLLKLEEILEQIIDSRSLNSFTQAGGLENSVLRKSGVASEGCSPKINEWRNKGLEGMFEDLHEMDTAFIDESYTYPIHLKSHVGAKFCHHATSSSTGSITSVSSTNTPRTSHFDSYWLERHCPEQEDLRLMMDLSDIARCGASTDFSKEGSCDYIMACMQDIQAVLKQGKLKALVIDTFGGRIEKLLCEKYLHARELTADKSSVGNIKESEDVLEHASATPQLLLKDRISIDDFEIIKPISRGAFGKVFLARKRTTGDFFAIKVLKKLDMIRKNDIERILQERNILITVRYPFLAEHLMLLMQVRFFYSFTCRDNLYLVMEYLNGGDLYSLLQKVGCLDEEIARIYIAELVLALEYLHSLKIVHRDLKPDNLLIAYNGHIKLTDFGLSKIGLINNTIDLSGHESDVSPRTNSHHFQKNQEEERIRHSAVGTPDYLAPEILLGTEHGLDTTFKSGFHEAPVNCYAADWWSAGIVLFELLTGIPPFTASRPEKIFDNILNGKMPWPDVPGEMSYEAQDLINRLLVHEPEKRLGANGAAEVKSHPFFQGVDWENLALQKAAFVPQPESINDTSYFVSRFSESSCSDTETGNNSGSNPDSGDELDECTNLEKFDSPPYYLSLINFSFKNLSQLASINHDVLLQKDPAKGGGDSPFKSHGT

SEQ ID NO: 20739 - protein, 187 aa, Escherichia coli K12
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHNGEGVFRGLANPLTVTRYHSLVVEPDSLPACFDVTAWSETREIMGIRHRQWDLEGVQFHPESILSEQGHQLLANFLHR

SEQ ID NO: 20740 - protein, 433 aa, Nitrosomonas europaea ATCC 19718
MKVQPAVQTNDNPRFVSTLTRNTLALILAGGRGTRLKNLTDWRAKPAVPFGGKFRIIDFTLSNCVNSGVRRIGVVTQYKAQSLIRHIQRGWSFLDGRFQEFIELLPAQQRTEEGTWYQGTADAVFQNLDILRTHNPGYVLILGGDHIYKMDYGRILAEHVERQADLTIACLEVPVEDASAFGVMAVDDSWRTTSFAEKPEHPAPIPGKPGHALISMGIYVFNAKFLYEQLIQDHDMDQSSHDFGKDVIPRLVASNARVYAHRFQNSCVNMASGVPYWRDVGTVDAYWKANIDLTTITPDLNLYDEDWPIWTHQEQLPPAKFVFDDDDRRGQALDSMVSGGCIISGATVRRSLLFSNVQIRGYSTIEDSVILPNVSIDRHAYLKRVVVEKECQIPEGLKVGFNPDEDRKHFYVTDDGITLITPEMLGQGIHYIR

SEQ ID NO: 20741 - protein, 514 aa, Zea mays
MPAGGFSVSAPSGVEFEAKITPIVIISCIMAATGGLMFGYDVGISGGVTSMDDFLGKFFPAVLRKKLEDKESNYCKYDNQPLQLFTSSLYLAGLTATFFASYTTRRLGRRLTMLVAGVFFIVGVIFNGAAQNLAMLIVGRILLGCGVGFANQAVPLFLSEIAPTRIRGGLNILFQLNVTIGILFANLVNYGTSKIHPWGWRLSLSLAGIPAALLTLGALFVTDTPNSLIERGRLDEGKAVLKRIRGTDNVEPEFNEIVEASRVAQEVKHPFRNLLQRRNRPQLVIAVLLQIFQQFTGINAIMFYAPVLFNTLGFKSDASLYSAVITGAVNVLSTLVSVYSVDRVGRRMLLLEAGVQMFLSQVAIAIVLGIKVTDHSDNLGHGWAIMVVVMVCTFVSSFAWSWGPLGWLIPSETFPLETRSAGQSVTVCVNLLFTFVIAQAFLSMLCHLKYAIFVFFSAWVLVMSLFVLFFLPETKNVPIEEMTERVWKQHWFWKRYMDDDNHHIVNGKLTGASV

SEQ ID NO: 20742 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVYEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 20743 - protein, 148 aa, Oryza sativa
MLLLLLRRRPDSTPTHHSRIGNYMLDNNFFRPAASAQFYLDQAQQSFPYNNGGRISVSKDKQDVEEVEAYRASFGFSADEIVTTQTYVEIPDALDEGFSISPFGNNAPATEVDKSLFNVKVITGPKKSTEQKLSNGSPQNVVHLDIFK

SEQ ID NO: 20744 - protein, 820 aa, Photobacterium profundum
MTTRGQTQQFDKALFKASVEKHLVTTYAKTPETADSRSWYLAVGKALAEISTGSLLETEKQLAEQNVRSVNYLSLEFLIGRLTGNNLISMGLYEEVSAAVEELGLNLTDLLEEERDPALGNGGLGRLAACFMDSLAAQEYPAVGYGLHYEYGLFSQSFEGGHQVEAPDAWRGIEGYPWEVVRPELGQTVGLFGSVETYTDKAGTICRRWVPAMTVEGVAWDLPIVGYDNKSVYPLRLWECRSPAPFNLARFNDGDYVGAQYGQLEAGNVTKVLYPNDNHDQGKTLRLMQQYFHCACSIADILRRHFAAGNKIEDLAKLESIQLNDTHPTIAIPELMRILIDEHKLGWDAAWAISSKVFAYTNHTLLPEALERWSESLIADMLPRHMEIIFEINHRFMTLVEEKWPGNNEIKRKLSIIEEGQQRMVRMANLCVVSTYAVNGVAALHSELVKRDLFPEFNELFPGRLHNVTNGVTPRRWLKFCNPGLTELVNEKIGTEWPAKLDQLSGLAKFAEDKKFQKRYLAVKKDNKQRFADWVQDNMGIELDTNAIFDVQIKRLHEYKRQHLNLLHILSLYHRLLNEPTFDMHPRVFIFAAKAAPGYALAKDIIFAINKVADKVNNDPRLGGKLKVVFVPDYRVSLAEIIIPAADVSEQISTAGLEASGTGNMKLALNGALTIGTMDGANVEIREEVGDENIFIFGLLVDEVLKQKEEGHDPYRYYHADSLLRASLDLLNTDEFTPGNPGQLSAIRQNLLDGGDPYLVLADFADYVKAHEKIDAEYRDQATWARKTILNTALVGKFSSDRSIRDYVNNIWKLKAVSVK

SEQ ID NO: 20745 - protein, 256 aa, GIBBERELLA ZEAE PH-1
MSSSQPQTNGVPASSAGTSQTVPNTQTTATSSSQPAVTASQNAPPPSAQSTSAPRPRDSRLIELLLTSQGVTAYEPRVPLLLLDFAYRHTSSVLSDALHLSGDPYVTQAGSKPSANAGAISAPAGDAAVTANAVKLAIAARLSYQLRGGNAGGGISKEYMQELARERNKVALPKIVPSEWGVRLPSERFVLSGTSWGLKDVWDEDDEEDDEMDQGGDAMEGIEGPEPEDVGGDGVEGGTVEDMFGEDVDEEMAEEG

SEQ ID NO: 20746 - protein, 429 aa, Arabidopsis thaliana
MVRSDENSLGLIGSMSLQGGGVVGKIKTTATTGPTRRALSTINKNITEAPSYPYAVNKRSVSERDGICNKPPVHRPVTRKFAAQLADHKPHIRDEETKKPDSVSSEEPETIIIDVDESDKEGGDSNEPMFVQHTEAMLEEIEQMEKEIEMEDADKEEEPVIDIDACDKNNPLAAVEYIHDMHTFYKNFEKLSCVPPNYMDNQQDLNERMRGILIDWLIEVHYKFELMEETLYLTINVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEKQLLACARKMVAFHHKAGTGKLTGVHRKYNTSKFCHAARTEPAGFLI

SEQ ID NO: 20747 - protein, 534 aa, GIBBERELLA ZEAE PH-1
MGILTLIEDRPTPPSVYNWRVYVLAIVASCGSNMIGYTSAFIGTTITLDSFRKEFGIDQKSAEERNLISENIVSLFIAGAFFGALLTYLLSHWIGRKWCLSIASATFTLGAGLQCGANSSTGLGILYAGRVLSGLGTGIASNIIPIYLSELAPPAIRGRLVGLYELGWQIGGLVGFWINYGVEKHMPESHQQWIVPFAVQIIPSGLLFLGTLWLRESPRWLFLKDRRTQAMKNLCWIRQLTPTDIYITEEVAAIDHAHEVQKHTVGLGLWKPFQALAQRPNMMYRLFLGCMLFFWQNGSGINAINYYSPTVFSSIGVQRDTVNVMTGVFGVVKAVMTFVWLLFLVDQLGRRKLLLIGGITGSICMWVLGAYIYIVDPTKNPQDHLTGSGIAAIVFFYLWTAVYTPTWNGTPWVINSEFFDPSFRSLAQACTTASNWLFNFLVSRFTEQMFAAMGYGVYMFFATLSFFAFIFAFFLIPETSGIPLEQVHRLFKIKPIWKAEGILKEQLKQEEQQFRHDVKADVSQTENLEDSDKV

SEQ ID NO: 20748 - protein, 451 aa, Kappaphycus sp. sacol
TDILALFRVSPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGLVCERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGVWARKNDMILHLHRAGNSTYSRQKIHGMNFRVICKWMRMAGVDHIHAGTVVGKLEGDPLMIRGFYNTLLLPYLDVNLLQGIFFEQDWASLRKVTPVASGGIHCGQMHQLLDYLGNDVVLQFGGGTIGHPDGIQAGATANRVALEAMVLARNEGRDYVAEGPQILQDAAKTCGPLQTALDLWKDITFNYTSTDTADFVETPTANV

SEQ ID NO: 20749 - protein, 740 aa, Coccidioides posadasii
GRNWEGFGSDPVLQAVASAETIRGIQENGVIATAKHYVLNEQEHYGQPLEWGISNAMASNIDDRTLREVYIWPFAESVRAGVGSVMCAYQMVNNSYSCGNSLLLNGILKDELGFQGFVQSDWWAQQAGVSTALAGLDMTMPGPGPRPSPGVSYWGSNLAIAALNTSVPMERLNDMATRIVAAWYQLGQDSWPKPPPDGDGGPNFSSWTREKIGRLHHGSNDDDATGVVNKFINAQSEGDDAHLHVARRIAAEGTILLKNEGGILPLSRNGRSRNAGLYRVGIYGEDAGPGKGPNFCRDRACNQGTLASGWGSGAVEFPYLIPPGEALDREFNNDTVELSLYYKNEVADRDLKDKDLCIVFANSNGGEGFVADGDIRGDRNDLFLQKDGDRLVEHVASKCGDGSGETIVVIHAVGPVIVESWVDYPGIKAIVLANLPGQESGDALADFLFGDVDACGRLPYTMGKSLDDYGPGARVLCESQRPVPQKDFSHGLYTDYRYFDKHNITPRYEFGYGLSYTTFRLSNLIVKPLQDRTPLPAPRPEPRVSPPSYNDEIPPPKDALFPKGFRRLSDYIYPYISSVKEVTQGPYEYPQGYNITQEPSQAGGGEGGNPSLFEPFVNVSVVLANTGPRTGKEVVQVYVSFPENVTDSQPLADGEKSNSTGNHTEPYNPLVTIEFPVRVLRNFEKVELASGEWTTVNMSLTRKDLSYWSTRQQNWMMPTAGAFKIWVGRSSRDLPLVGKF

SEQ ID NO: 20750 - protein, 402 aa, Oryza sativa; identical to SEQ ID NO: 1286

SEQ ID NO: 20751 - protein, 419 aa, Mycobacterium leprae
MPPWQRWAAADRFGAMREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 20752 - protein, 558 aa, Oryza sativa; identical to SEQ ID NO: 1727

SEQ ID NO: 20753 - protein, 355 aa, Burkholderia fungorum
MARGDPRIRRRDSHHLRRTRRGNPARHCAWRAQGQYRHRHPARNERRDAQVDGECARRVRPARGIEGGDGGGQRDLRRTVRSVRLCGPGLAHQAAAARCDGAPVSLNHSPVRKETAMRDFLIAPSLLSADFARLADEIRDVTAAGADWIHLDVMDNHYVPNLTVGPLVCAAIRPHTSVPIDVHLMTMPVDSLVAGFAEAGANTISFHPEASLHVHRTIELIKSSGARAGLALNPATPLAVLDHVIERLDVVLVMSVNPGFGGQAFIPETLDKLRALRERVDATMQRTGRLLLIEVDGGVKAANIARIAASGADVFVAGSAVFGADDYAQAIGEMRDELERVSDESEGAGVLAVVR

SEQ ID NO: 20754 - protein, 448 aa, Zea mays
MERARARAPALALAPVEVPKFFVCPISLEVMRDPVTLSSGITYDRDSIERWLFTDGHGDCPVTKLPLGADDLEPTPNHTLRRLIQSWCAAHAVERFPTPRPPVDADRVAAIVGCAKKGGQQEVLAALRELADIIGESDRNRRCVEGVPEAVEFLVSVVKKHAAGTSSSKPLGGCRSQEEPMCGVPDSPKACSPEEAALSILHSLKLSEASLKRALESSDGFVDTLASVLRWPPNYRARTYAMHLLKAALSAMQPSQLSSASTDLVEGVVRVVADRTLSPKAIKVALHVLCRLCPWGRNRVKAVEAGAVAAVVELLLNEGCGCGGSNGKRAVELAVVAIDHLCGCAEGRLELVAHPAGLAVVARAATRLSPTATESAVRALHAVARHSATPAVLQEMLAVGVVARLLYLVQAGASGERPRERAREMLKMHARVWRGSPCLASHMASYPC

SEQ ID NO: 20755 - protein, 354 aa, Neisseria meningitidis MC58
MALVSMRQLLDHAAENSYGLPAFNVNNLEQMRAIMEAADQVDAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVCFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMASRYAKGELNQIVK

SEQ ID NO: 20756 - protein, 519 aa, Rhodobacter sphaeroides
FFLTSAALQDILRRFKSGHGDLRALSRHVAIQMNDTHPAIAGPELIRLLVDEHGLSFDEALPVAQECLGYTNHTLLPEALERWATFTFGNVLPRHMQIVERIDGWHRRTFPARPHYVGIVKHHEVRMGELAFIMSHKVNGVSALHTDLVKANLFPELDRLHPEKIVNQTNGVTPRRWLKMANAPLARLIGETIGEGWEDDLDRLKGLEPHVKDQGFLGAFDAAKRQNKVTLSNWLGAECGVKVSPDALFDVQVKRIHEYKRQLLNILETVARWQAIRANPDAGWVPRVKIFGGKSAPGYAVAKEIIHLINDVAAVINADPLVGDLLKVIYPANYNVSMAERLVPAADLSEQISTAGKEASGTGNMKFMMNGAPTIGTLDGANVEILQEVGRENFFLFGLTAEEVMKRREDPDHARKAIEASQIMQNVLQAIAEGQFSPGQADRYHGLVHRVWHHDYFLVASDFDAYLAAQAEVDAAYKDRARWLTMAALNTARSGFFSSDRTIRGYMKEIWGVESALQD

SEQ ID NO: 20757 - protein, 336 aa, Zea mays
  unsure (1)..(336): unsure at all Xaa locations
MFRSALVRSSASAKQSLLRRSFSSGSVPERKVAILGAAGGIGQPLALLMKLNPLVSSLSLYDIANTPGVAADVGHINTRSQVVGYMGDDNLAKALEGADLVIIPAGVPRXKPGMTRDDLFNINAGIVKNLCXAIAKYCPHALVNMISNPVNSTVPIAAEIFKKAGMYDEKKLFGVPTLDVVRAKTFYAGKANVPVAEVNVPVIGGHAGVTILPLFSQATPQXNLSNDVLTALTKRTXDXSTEVVQAKAGKGSATLSMAYAXALFADACLKGLNXSPELVKCSYLEATITEVPFFASKXRLGKKGGEGVFSFGPLLNFEXQGWETLNPNLSFSLKGG

SEQ ID NO: 20758 - protein, 451 aa, Neisseria gonorrhoeae
RFVDLRFTDTKGKQHHFTVPARIVLEGPEEWFENGQAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEF

SEQ ID NO: 20759 - protein, 462 aa, Salmonella enterica subsp. enterica serovar Typhi Ty2
MTMMTATQALSVNPATGQTLAAMPWANAQEIEHALSLAASGFKKWKMTSVAQRAQTLRDIGQALRAHAEEMAQCITREMGKPIKQARAEVTKSAALCDWYAEHGPAMLNPEPTLVENQQAVIEYRPLGVILAIMPWNFPLWQVLRGAVPILLAGNSYLLKHAPNVTGCAQMIARILTEAGTPAGVYGWVNANNEGVSQMINDPRIAAVTVTGSVRAGAAIGAQAGAALKKCVLELGGSDPFIVLNDADLELAVKAAVAGRYQNTGQVCAAAKRFIVEEGIAQAFNDRFVAAAAALKMGDPLVEENDLGPMARFDLRDELHQQVQASVAEGARLLLGGEKIAGEGNYYAATVLADVTPDMTAFRQELFGPVAAITVAKDAEHALALANDSEFGLSATIFTADDTLAAEMAARLECGGVFINGYSASDARVAFGGVKKSGFGRELSHFGLHEFCNVQTVWKNRV

SEQ ID NO: 20760 - protein, 245 aa, Dechloromonas sp. RCB
MTDVLDEILKLLDGGFKTDPEVADWWKQIDEWRGRDSLRYKQGEHIMPQYVVEKLYEVTGGDAFITSDVGQHQMFAAQYYKFDKPRRWINSGGLGTMGVGLPYGMGVLLANPGAQVACVTGEGSIQMCIQEMSTCKQYELPVKIINLNNGMLGMVRQWQEMFYSKRYSQSYVTSLPDFVKLAEAYGHVGMRIEKPEDVEPALRKAFTEHKNDLVFMDFIIDPGANVFPMVAAGKGLTEMILAEDL

SEQ ID NO: 20761 - protein, 506 aa, Oryza sativa
  unsure (1)..(506): unsure at all Xaa locations
MESPLSHPAMVALSLLLLVALYLARRAVLGKKRRYPPVAGTMFHQLLNFGRLLEYHTELSRKYRTFRMLTPTCNYVYTVEPANVEHILKTNFANYGKGPMTHDVLEDLLGDGIFNVDGGMWRQQRKVASLEFSTRVLRDYSSAVFRDTAAELAGILERGPAAKGRERVDMQDLLMRATLDSFFRVGFGVNLGVLSGSSKEGLVFARAFDDASEQXLFRFFDLLWKVKRFLNISAEATMKQSIRTINDFVYSIIDRKIEQMSREQHEFAKKEDILSRFLLEREKDPGCFDNKYIRDIILNFVIAGRDTTAGTLSWFLYAVCKNQRVQDKIAREVRDATTGDRDVGVQDFSSFLTEDAINKMQYLHAALTETLRLYPGVPLDVKYCFSDDTLPDGHAVKKGDMVNYQPYPMGRMKFLWGDNAEEFKPERWLDDSGMFVAESPFKFTAFQAGPRICLGKEFAYRQMKIVSAVLLYFFRFEMWDDDATVGYRPMLTLKMDGPFYLRALAR

SEQ ID NO: 20762 - protein, 210 aa, Zea mays
RACSSLLPVLHPVPSPSAPADAAFSSPRQRRGSTDARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELPELKGRGKLGDRPVFVLVEADA

SEQ ID NO: 20763 - protein, 187 aa, Shigella flexneri 2a str. 301
MILLIDNYDSFTWNLYQYFCELGADVLVKRNDALTLADIDALKPQKIVISPGPCTPDEAGISLDVIRHYAGRLPILGVCLGHQAMAQAFGGKVVRAAKVMHGKTSPITHSGEGVFRGLANPLTVTRYHSLVVEPDSLPACFDVTAWSETREIMGIRHRQWDLEGVQFHPESILSEQGHQLLANFLHL

SEQ ID NO: 20764 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGHDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 20765 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 20766 - protein, 454 aa, Rhodophyllis reptans
IKETDILALFRVSPQPGVDPIEASAAVAGESSTATWTVVWTDLLTACDLYRAKAYKVDAVPNTTDQFFAFIAYDIDLFEEGSIANLTASIIGNVFGFKAVKALRLEDMRIPVAYLKTFQGPATGIVSERERMDKFGRPFLGATVKPKLGLSGKNYGRVVYEGLRGGLDFLKDDENINSQPFMRWKERYLYAMEGVNRSVAATGEIKGHYLNVTAATMEDMYERAEFAKQLGSIIIMIDLVIGYTAIQTMGIWARKNDMILHLHRAGNSTYSRQKIHGMNFRVICKWMRMAGVDHIHAGTVVGKLEGDPAMIQGFYNTLLLPHLVVNLPQGIFFEQDWASLRKVTPVASGGIHCGQMHQLLDYLGIDVVLQFGGGTIGHPDGIQAGATANRVALESMVIARNEGRDYVAEGPQILQDAAKSCGPLQTALDLWKDITFNYTSTDTADFVETPTANV

SEQ ID NO: 20767 - protein, 245 aa, Lolium temulentum
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRSRKSQLMHESISELQKKERSLQEENKILQKELIEKQKAHTQQAQLEQTQPQTSSSSSSFMMGEATPATNRSNPPAAASDRAEDATGQPPARTVLPPWMVSHLNNG

SEQ ID NO: 20768 - protein, 230 aa, Pneumocystis carinii
MAPSSLSFPSSHILMSGAMYPGSRDEKGMEHGVVSTSLNQTATNTFAGVSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDVKFPIRLEGLAYSHGTFSSYEPELFPGLIYRMVKPKIVLLIFVSGKIVLTGAKVREEIYQAFEAIYPVLSEFRKSS

SEQ ID NO: 20769 - protein, 147 aa, Geobacter metallireducens
MAIVKYTPFGDLRNLQEQMNRLLDMAWSRESGEELREGVWQPPVDIFEDENGVVIKAELPGIDQKDIEVKIEDNTLTIRGERKHDQEVKKENYHRVERYYGSFMRSFSLPTTIDRDTVKAVCDKGILTITLPRREETKPKQINVEVK

SEQ ID NO: 20770 - protein, 495 aa, Arabidopsis thaliana
MDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGSLHISCLYCLCVCLL

SEQ ID NO: 20771 - protein, 268 aa, Saccharomyces cerevisiae
MVLEATVLVIDNSEYSRNGDFPRTRFEAQIDSVEFIFQAKRNSNPENTVGLISGAGANPRVLSTFTAEFGKILAGLHDTQIEGKLHMATALQIAQLTLKHRQNKVQHQRIVAFVCSPISDSRDELIRLAKTLKKNNVAVDIINFGEIEQNTELLDEFIAAVNNPQEETSHLLTVTPGPRLLYENIASSPIILEEGSSGMGAFGGSGGDSDANGTFMDFGVDPSMDPELAMALRLSMEEEQQRQERLRQQQQQQDQPEQSEQPEQHQDK

SEQ ID NO: 20772 - protein, 497 aa, Mesorhizobium loti
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAETLEYGMVGINTGRMSSEAAPFGGMKQSGIGREGSRHGLEDYLEMKYLCMGGL

SEQ ID NO: 20773 - protein, 447 aa, Meristiella sp.
ALFRVSPQPGVDPIEASAAVAGESSTATRTVVWTDLLTACDLYRAKAYKVGAVPNTSDQFFALIAYDIDLFEEGSIANLTASIIGNVFGFKAVKALRLEDMRIPVAYLKTFQGPATGLVSERERMDKFGRPFLGATVKPKLGLSGKNYGRVVYEGLKGGLDFLKDDENINSQPFMRWKERFLYAMEGVNRSIAATGEVKGHYLNVTAATMEDMYERAEFAKQLGTVIIMIDLVIGYTAIQTMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGIDVVLQFGGGTIGHPDGIQAGATANRVALEAMVLARNEGINYVEEGPQILQDAAKTCGPLQTALDLWKDITFNYTSTDTADFVETPTANV

SEQ ID NO: 20774 - protein, 200 aa, Cichorium intybus x Cichorium endivia
MATIGHNNLNAKLVLLGDMGAGKSSLVLRFVKGQFLEFQESTIGAAFFSQTLVVNDATVKFEIWDTAGQERYHSLAPMYYRGAAAAIIVYDITSADSFTRAKKWVQELQKQGNPNMVMALAGNKADLEDKRKVTVEEARVYAEENGLFFMETSAKTAANVNDVFHEIAKRLPRAQPTQNPAGMVLVDRPAEGARAASCCS

SEQ ID NO: 20775 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLRPMGIAWVFMVFSVICLLSFFFAFYMVPETKGKSLEEIEASLKKRFKKKKSTQNQVLNERTL

SEQ ID NO: 20776 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 20777 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 20778 - protein, 288 aa, Escherichia coli
IGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEQNALEGMLNTL

SEQ ID NO: 20779 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 20780 - protein, 242 aa, Zea mays subsp. parviglumis
SIRNNPVQNKLMNGEDPINNNHAQTAGLGVRLATSSSSRDPSPSDEDMDGEVEILGFKMPTEERMRKRKESNRESARRSRYRKAAHLKELEDQVAQLKAENSCLLRRIAALNQKYNDANVDNRVLRADMETLRAKVKMGEDFLKRVIEMSSSVPSSMPISAPTPSSDVPVPPPPIRDSIVGYFSATAADDDASVGNGFLRLQAHQEPASMVVGGTLSATEMNRVAAATHCAGAMELIQTAMG

SEQ ID NO: 20781 - protein, 172 aa, Oryza sativa
  unsure (1)..(172): unsure at all Xaa locations
MLPCFGILANGVLQPDGRDRRREPRGAARRARDAGADDADRELRPHHAPFGHTSSATRASSECESEPHPDRQGGGALLHALGGRLTSQPDEEACLNRLAVLKLNGGLGTTXMDCTRPNIVIEGRNGCTVIYLIVIQIEYVIKRDGRTGPLLLMNSFITHDDAHKIEDDVLQL

SEQ ID NO: 20782 - protein, 162 aa, Triticum aestivum
MEGRMFGLETPLMTALQHLLDVPDSESGGAGNAGGERQGPTRAYVRDARAMAATPADVKELPGAYAFVVDMPGLGSGDIKVQVEDERALVISGERRREEKEDARYLRMERRMGKLMRKFVLPENADMEKISAVCRDGVLTVTVEKLPPPEPKKPKTIQVQVA

SEQ ID NO: 20783 - protein, 457 aa, Nereocystis luetkeana
  unsure (1)..(457): unsure at all Xaa locations
DYNVKDTDILALFRITPQPGVDPVEAAAAVAGESSTATWTVVWTDLLTACDIYRAKAYRVDPVPGTXDQFFAYIAYECDLFEEGSLANLTASIIGNVFGFKAVKALRLEDMRIPFAYLKTFQGPATGVVXERERLDKFGRPFLGATVKPKLGLSGKNYGRVVXEGLTGGLDFLKDDENINSQPFMRXKERXLYCMEGVNRAAAATGEVKXSYLNITAAXIEQMYERAEYAHSIGTVIVMIDLVIGYTAIQTMAIWARKAEMILHLHRAGNSTYARQKNHGINFRVICKWMRMCGVDHIHAGTVVGKLEGDPLMVRGFYNSLLLTQLKINLAEGLFFDMDWASLRKCVPVASGGIHCGQMHQLLYYLGDDVVLQFGGGTIGHPDGIQSGATANRVALESMVLARNEGRDYVGEGPEILRNAAATCGPLKAALDLWKDXTFDYTSTDTPDLVEVATESK

SEQ ID NO: 20784 - protein, 431 aa, Zea mays; identical to SEQ ID NO: 3818

SEQ ID NO: 20785 - protein, 461 aa, Oryza sativa
MISSRKLAQLGKKWQRMVASSGRQTASIDGCCSTATAYVADKGHCVLYTTDGARFEVPLMYLNTAIFCELLRVSQEEFGFASNNKITLPCDASVMEYVMCLIRRDASEEIEKALLSSIVRPLKGHCIMYTADGRRFEVPLAFLATTIFAELLRMSQEEFGFTTDGGITLPCDAEVMEYVLCLLRRNASEEVVRAFLSTIVKSCHYGNGFAQSLGRVAQLAKKWQRMAALGRKRLTVRAKQDQECCSSMAGKGHCAMYTADGSRFEVPLAYLGTAVFSELLRMSQEEFGFSIDGRIMLPCDAAVMEYAMCLLRRNASVEVEKALLSSMVASCHYTGSMVPTVGPEFWQGIVTTELRNALSTSSDAFLLSKHITYSIAAASQGSVILPSPPANPNSSCDILRSSTNTVVPRYGNGTSNRAPSDVYTAQWPLSATGDGEVDVQPASSSSLLLAAVLILCSFLAS

SEQ ID NO: 20786 - protein, 357 aa, Prochlorococcus marinus subsp. pastoris str. CCMP1378
MALVPLRLLLDHAAENRYGIPAFNVNNLEQVQAIMEAAYETDSPVILQASRGARNYAGEIFLRHLILAATETYPNIPVVMHQDHGNEPSTCYSAAINGFTSVMMDGSLEADAKTPASYEYNVAVTKKVVDFAHSVGVSVEGELGCLGSLETGKGEAEDGHGFEGELSTDMLLTDPEEAADFVAKTKVDALAIAIGTSHGAYKFTRKPTGEVLAISRIAEIHKALPNTHLVMHGSSSVPQEWLDIINKYGGEIPQTYGVPVEEIQEGIRNGVRKVNIDTDNRLAFTAAVREAAFADTANFDPRHFNKPARKYMKQVCLDRYKQFWCEGQASKIKQSSTNYYADLYAKGNLDPKVKAAV

SEQ ID NO: 20787 - protein, 338 aa, Xylella fastidiosa Dixon
MSVALSIDLSKKKTILCFGEALIDMLAQPPVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 20788 - protein, 296 aa, Microbulbifer degradans 2-40
MLELSPANQTDYSLGFGGDTLNTAIYFARLGGEVDFVTALGDDHLSENMIRAWDKENVGTSLVKRTPGALPGLYMIQTDDEGERSFHYWRKNAPARTLIEDWPEVLTNLNAFPAIYLSGITLSLYSPQSRTALFNFLDEYRAQNGQVIFDINYRPASWPDKTEALATFDEMLKRTDTALPSFDDEKLLHGEHSKTECLERYLTAGAKEVVIKDGVNGCLLHTNNQSVLLPVPAKVTPVDTTAAGDSFNGAYLAARLNGASAERAVAQGQACAALVIQHRGAIVPINAFRASDIKNN

SEQ ID NO: 20789 - protein, 363 aa, Bacillus subtilis subsp. subtilis str. 168
MTKQTIRVELTSTKKPKPDPNQLSFGRVFTDHMFVMDYAADKGWYDPRIIPYQPLSMDPTAMVYHYGQTVFEGLKAYVSEDDHVLLFRPEKNMERLNQSNDRLCIPQIDEEQVLEGLKQLVAIDKDWIPNAEGTSLYIRPFIIATEPFLGVAASHTYKLLIILSPVGSYYKEGIKPVKIAVESEFVRAVKGGTGNAKTAGNYASSLKAQQVAEEKGFSQVLWLDGIEKKYIEEVGSMNIFFKINGEIVTPMLNGSILEGITRNSVIALLKHWGLQVSERKIAIDEVIQAHKDGILEEAFGTGTAAVISPVGELIWQDETLSINNGETGEIAKKLYDTITGIQKGAVADEFGWTTEVAALTESK

SEQ ID NO: 20790 - protein, 522 aa, Monilinia fructicola
MGVLETIAGPLAQEISQRSTGTIIAAGVAAFVVLAVVLNVLNQVLFANPNEPPVVFHWLPIIGSTITYGIDPYRFFFDCRAKYGDVFTFILLGKKTTVYLGRKGNDFILNGKHKDLNAEEIYTVLTTPVFGKDVVYDCPNAKLMEQKKFMKIGLSTEAFRSYVPIIQMEVENFMKRSSAFKGQKGTANIPPAMAEITIYTASHTLQGKEVRDRFDTSFASLYHDLDMGFSPINFMLHWAPLPHNRARDHAQRTVASTYMDIIQKRRAQATEAEFKSDIMWQLMRSSYKDGTPVPDKEIANMMIALLMAGQHSSSSSISWIMLRLAARPDIMEELYQEQIEVLGADLPDLKYEDLSKLTLHQNILKETLRLHTPIHSIMRKVTTPMPVSGTKYVIPTSHTLMASPGCTSRDAEYFPEPLEWDPHRWDIGSGRVIGNDQDEEFQDYGYGMISKGASSPYLPFGAGSHRCIGEQFANVQLITIMATVVRLFKFKNPDGSKDVIGTDYTSLFTGPLEPAVVAWERR

SEQ ID NO: 20791 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYVHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 20792 - protein, 517 aa, Oncidium cv. 'Goldiana'
MELCMKSQIALSAAVLQPHAGSGRFSDGETMGQRLDFSSFRRANEQICRRRRASLLRMSFATTELVAEGKLRDLELEGRDPRTVVAVILGGGAGTRLFPLTRQRAKPAVPIGGAYRLIDVPMSNCINSGINKVYILTQFNSASLNRHLLRAYNFSNGIGFGDGFVEVLAATQTPGEAGKKWFQGTADAVRQFHWLFEDAKGKEIEDVLILSGDHLYRMDYMDFVQSHRQSGADITISCVPMDVSRASDFGLMKIDNNGRVLSFSEKPKGQELKAMEVDTSVLGLSREQAKKTPFIASMGVYVFKKEILLNLLRWRFPTANDFGSEIIPASAKELFVKAYLFNDYWEDIGTIKSFCEANLSLTRHPPNFSFYDATKPIYTSRRNLPPTAINNSKIVDSIISHGSLLSNCLIEHSVVGIRSRINDNVHLKDTVMLGADLYETDAEIAALLAEGRVPVGIGENTKIKDCIIDKNARIGKNATISNVDGVQEADRSAEGFYTRSGITVILKNSTIPDGFAI

SEQ ID NO: 20793 - protein, 303 aa, Mycobacterium tuberculosis H37Rv
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTEVVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 20794 - protein, 373 aa, Oryza sativa
MADEKLAKLREAVAGLSQISGEEEHVEWAKIHTPTDEVVVPYDTLAAPPEDLEETKKLLNKLAVLKLNGGLGTTMGCTGPKSVIEVRNGFTFLDLIVIQIESQYPRVVADEFLPWPSKGKTCKDGWYPPGHGDIFPSLMNSGKLDLLLSQVTPKTLADVKGGTLISYEDKVQLLEIAQVPDAHVHEFKSIEKFKIFNTNNLWVNLKAIKRLVEADALKMEIIPNPKEVDGVKVLKVETAAGAAIRFFDHAIGINVPRSRFLPVKATSDLQLVQSDLYTLVDGFVTRNPARTNPSNPSIELGPEFKKVGCFLGRFKSIPSIVELDTLKVSGDVWFGSSITLKGKVTITAQPGVKLEIPDGAVIENKDINGPEDL

SEQ ID NO: 20795 - protein, 291 aa, Triticum aestivum
  unsure (1)..(291): unsure at all Xaa locations
MAGLSMEHPWAFAFGLLGNIISFSSLLAPIPTFYRIFKSKSTEGFQSVPYVVALFSAMLWIFYALVKTGEGLLITINAAGCVIETIYIVMYLVYAPRKAKIFTAKIVLLLNIAGFGLIFLLTVFAFQGETRVISLGWICVGFSVCVFVAPLSIIGRVIKTKXSVEYMPFTLSLTLTLSAIVWFLYGLLIKDKYVALPNILGFTFGVIQMVLYVFYMNKTPVASEVKEGKEAWKVPAEDHVVVINVGKADKSSCAEVRPVTEMAGAVDVPRRCAAEAAAAPGMDFARSVDVV

SEQ ID NO: 20796 - protein, 172 aa, Triticum aestivum
  unsure (1)..(172): unsure at all Xaa locations
RKECEGKLCYDFSTXEVFGDKAVRQAIGVGDIEFVSCSTSIYQAMLTDWMRNLEVGIPALLEDGINVLIYAGEYDLICNWLGNSRWVHSMEWSGQKDFCQNXESSFLVDDAQAGVLKSHGALSFLKVHNAGHMVPMDQPKAALEMLRRFTQGKLKEAVPEEESSTTTFYAAM

SEQ ID NO: 20797 - protein, 470 aa, Aureococcus anophagefferens
GVIPYAKMGYWDASYQVKATDLLALFRITPQPGVDPVEAAAAVAGESSTATWTVVWTDLLTACDVYRAKAFRVDPVPSAPDQFFAYIAYEGDLFEEGSLANMTASIIGNVFGFKAVKALRLEDMRIPHSYLKTFQGPATGVVVERERMDKFGRPLLGATVKPKLGLSGKNYGRVVFEGLKGGLDFLKDDENINSQPFMRWRERFIYCVEGINRAAAATGEVKGSYLNITAATMEEMIIRAEYAKELGSIIIMIDLVIGYTAIQTMAIWSRENDMLLHLHRAGNSTYARQKSHGINFRVICKWMRMAGVDHIHAGTVVGKLEGDPLMVQGFYDTLLKTKLAIDLPKGIFFDMDWAALRKCMPVASGGIHCGQMHQLLNYLGDDVILQFGGGTIGHPDGIQAGATANRVALEAMVLARNEGRNYVEEGPQILRDTAKMCGPLQTALDLWKDISFNYASTDTADFAETPTANV

SEQ ID NO: 20798 - protein, 196 aa, Methanothermobacter thermautotrophicus str. Delta H
MVVILIIDNYDSFTHNLYQLAGEILRDEGMDEEIMVLRNDEARISDLRALDPEKIIISPGPGNPSRRSDFGVCMDVIGEFTDRPLLGVCLGHQGIFHAFGGRVDQGEPVHGKIVEVFHDGSELFRDVPNPFRATRYHSLVCRPEDTPADIEVTAVTSDEIIMAIKHREYPVYGLQFHPESAGTPSGRTVIRNFLRM

SEQ ID NO: 20799 - protein, 307 aa, Clostridium perfringens str. 13
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVSGNSVASMKLLKEIADKLKLDIFR

SEQ ID NO: 20800 - protein, 344 aa, Nitrobacter hamburgensis
IGCHTCSIACKNIWTDRKGTEYMYWNNVETKPGTGYPTRWEDQTKYRGGWVVDGTRQKSLRLRLQGKWGTLTNIFYNPYLPTLDDYFEPWTYDYQNLINAPLADEQPTARAISMVTGKYMDTIEAGPNWDDDLGGSQVYANNDPNYDGASDEEMRQINEINSTVFFYLPRICNHCLNPGCVAACPQGAIYKRGEDGVVLVSQERCRAWRMCVSGCPYKKTYFNWSTGKAEKCILCYPRLESGQPPACFHSCVGRIRYIGLVLYDADAIEETAEAPQDQLVAAQRNIIKDPFDPKIIEAARANGIPDSKIEAAQKSPVYQFVKKWGIALPLHPEFRTLPMLFYVP

SEQ ID NO: 20801 - protein, 651 aa, Brucella suis 1330
MSGELNGNDTSAQAAVSAGSVLEGAAFADEGEQHNESMKTLVLGALGVVYGDIGTSPIYAFREALHAAATNGILARSDILGVVSLIFWALTLVVTVKYVLFVLRADNNGEGGILSLMALVRGALKGRPDLILGVGICGAALFFGDAVITPAISVLSAMEGLEIVAPNLTPFVVPATVVILVTLFSVQKLGTGRVAIVFGPIMALWFVALGASGLWHIFDDPTVMAALNPYYAVRFLTVSPAVAFVTVGAVFLAMTGAEALYADLGHFGRKPIVRAWLWIVFPCLLLNYFGQAAFILSHGEAAALPFFQMIPSFALWPMVLLATAATVIASQAVITGAYSVARQAVQLNILPRLEIQHTSEKLHGQIYIPRVNLLLGLAVVILVLGFEKSSNLAAAYGIAVTGNMLVTTVLLYIVMTRIWNWRVSRALPIILGFLVIDMLFFSANIIKVHEGGWASIGIATVLVLIMWTWVRGTRHLFQKTRKAEVPLDLIVEQMAKRPPTIVPGTAVFLTGDPKSAPTALMHSLKHYKVLHENNVILTVVTASKPWVASADRARVSQYNERFMLVTLTFGYMQQPNILRALGLCRRLGWKFDIMTTSFFLSRRSLKASVHSGMPLWQDKLFILLARTASDATEYFQIPTGRVVEIGTQVNI

SEQ ID NO: 20802 - protein, 547 aa, Sorghum bicolor
MARRAASSLVSRCLLARASAPAAPPAVPSALRRPDGMRGLLPGVLQRFSTAAAVEEPITPSVQVNYTKLLINGNFVDAASGKTFPTLDPRTGEVIAHVAEGDAEDINRAVAAARKAFDEGPWPKMTAYERSRILLRFADLIEKHNDELAALETWDNGKPYEQAAHIEVPMVARLMRYYAGWADKIHGLVVPADGPHHVQILHEPIGVAGQIIPWNFPLLMFAWKVGPALACGNTLVLKTAEQTPLSALYISKLLHEAGLPEGVVNVVSGFGPTAGAALASHMDVDKLAFTGSTDTGKVVLELAARSNLKTVTLELGGKSPFIIMDDADIDHAVELAHFALFFNQGQCCCAGSRTFVHERVYDEFVEKAKARALKRVVGDPFRKGVEQGPQIDDEQFNKILRYIRSGVDSGANLVTGGDRLGEKGYYIQPTIFSDVQDGMKIAQEEIFGPVQSILKFKDLNEVIKRANASPYGLAAGVFTNSLDTANTLTRALRAGTVWINCFDIFDAAIPFGGYKMSGIGREKGIDSLKNYLQVKAVVTPIKNAAWL

SEQ ID NO: 20803 - protein, 160 aa, Glycine max
MGSEGSAPVVVPRNFRLLEELERGEKGIGDGTVSYGMDDADDIYMRSWTGTIIGPPNTVHEGRIYQLKLFCDTDYPDKPPTVRFQTRINMTCVNQETGLVEPSLFPMLGKWEREHTMEDILASLKREMSTPQNRRLYQPHEGNEDQRVEQKGLSLRCVVM

SEQ ID NO: 20804 - protein, 778 aa, Thermoanaerobacter tengcongensis
MKGIIMAGGEGSRLRPLTFDIPKPLVPVANKPAIKHIVEHLHKYGVGELAVTLFYLPHKIKDYLLEEYGNEIKFYTEEKPLGTAGSVKNAKDFLKETFIVMSGDVITDVNIKEVYDFHRKKGSKVTLVLKKVEIPLEYGVVIVDETGKIVKFLEKPSWGEVFSDTVNTGIYIIEPEILEFIPEDRPFDFSKDLFPLLLKENIPMYGYITEGYWCDIGNTAQYLSSHFDVLEGKLDLGYRKILLEEGKVIGKKVLMSSGAKLILPLIIGNEVVIEENAVVGPNVVIGRGTIIKKGSHVKNSVLWEDVYVGENSELNGAVVCNKVRIDSNARILENAVIGEGVRIKAFAEIRPDVKVWPFKVIEEEAVVSKDVVWGNGRKNLSFGYRGIRGIFNEEIGPYQAVEIGEAFGDLMKGKVIVGSDEELASSLIADLIAYGLAFSGCEVLKSNSFLLPALRVGIRLRSAKGGVYVERIGEEIRILFLDGEGMDIDRNLEKKIENKLKIHDISRRKIEDIKPIKEVDVEGDYKDYLVKNRADSFKIKVKPHDEWTKKVLLQIKGEQILDDQNYHLKVKLKKNGEEIELYDEKDRKFDEDEVNYLKMLIAREKGLKKVVLPFNSSKYLAEFAEELAVETVVGKISPRDLMRSMTNLEEGRQVYFDLSFDGINFLLEVIEYVRLKNKRLSEIKDSFPLRYKTVKRIRCDWKDKGRIIRELFETRKNNVTFLDGLRFEEDEGWVLVVPDSELPFCNVYVEALTPEKAERLFTIYEKKIQDILLKNDGK

SEQ ID NO: 20805 - protein, 217 aa, Helicobacter pylori J99
MKVAPSLLSADFMHLAKEIESVSNADFLHVDVMDGHYVPNLTMGPVILENVTQMSQVPLDVHLMVENASFFVELFAPLNPQIISIHAENEKHPHRVLQLIKSSGITPGIVLNPHTHEESIKYLLESVGLVLLMSVNPGFGGQKFLDLVLEKCLKVKELIKRYNPSCLLEVDGGVNDKNIFELQQAGVDVVVSGSYIFESKDRKLAIEGLQNVRQPLA

SEQ ID NO: 20806 - protein, 131 aa, Edwardsiella tarda
VTAINRGDYPKWDLYIQVLKPADLKNFDFDPLDATKVWPDVPERKIGEMVLNKNPDNVFQETEQVAMAPSNLIPGIEPSEDKLLQGRLFAYADTQFYRIGANGLSLPINKPHSVVNNGNQDGQLNSGHTLD

SEQ ID NO: 20807 - protein, 436 aa, Magnetococcus sp. MC-1
MKSIKRTLLPAAALAMGSILPATAWAEDTLDSGNTAWMLTSTALVLFMTLPGLALFYAGMVRSKNVLSVLMQCFAIAGVMSILWAIYGYSLAFSSAADAGVNQFIGGMGDFFLKSVKADSLSGSIPTSVFVTFQMTFFIITPALIVGGFAERMKFSSMLVFMALWGTIVYLPICHAVWGGGFMAEDGVLDFAGGTVVHINAGVAGLVAALVLGKRRGYPTTAMPPHNLSLTVTGAAMLWVGWFGFNAGSELAADGTAGMAMLVTQLAAATAAIVWMALEWMKHGKPSVLGIATGAVAGLVAITPASGTAGPMGGILIGLAAGFFAFIGATSIKRALGYDDSLDAFGVHGIAGIVGAILTGVFADASLGGSGLAEGKTIMSQVAVQTTSVGYTIVYCAVATFIILKVLDVIMGLRVDDEAEEMGLDLAEHDERGYNI

SEQ ID NO: 20808 - protein, 459 aa, Platychrysis sp. TKB8934
DPDYVIKDTDILALFRCTPQPGVDPVEAAAALAGESSTATWTVVWTDLLTACDLYRAKAYRVDPVPSAADTYFCYIAYDLDLFEEGSLANLTASIIGNIFGFKAVKALRLEDMRFPVALLKTYQGPATGLIVERERMDKFGRPLLGATVKPKLGLSGKNYGRVVFEGLKGGLDFLKDDENINSQPFMRYRERFLYSMEGVNHAAAMTGEVKGHYLNATAATMEDMYERADFCKELGSVIVMIDLVIGYTAIQSMAKWSRKSDMILHLHRAGNSTYSRQKNHGMNFRVICKWMRMAGVDHIHAGTVVGKLEGDPLMIKGFYNTLLDFKSEVNLPEGLFFAQDWASLRKCVPVASGGIHCGQMHQLINYLGDDVVLQFGGGTIGHPDGIQSGATANRVALECMVLARNEGRDYISEGPQILRDAAKSCGPLQTALDLWKDITFNYASTDTADFVETPTANV

SEQ ID NO: 20809 - protein, 518 aa, Oryza sativa
MAPWRAAAMASSQLARRAARRLLSSQHRRHCAAPACPWLLGSAPPVLAPSPVAAAAAGDRRGFCSVRRFTGESNAAAAVEEAENGLVAGGDQHLCAYSLGCKVTAKPSIPPLSFHERKRNLVERKQAIDFPGGKVSFVAEMNFLPESQRDRINCYRVLDDDGRTISGSRFQEVSKELALKMYNEMATLQVMDTIFFEAQRQGRISFYLTSHGEEAINIASAAALTIDDIVLPQCFGNKLDYGKGRQMPIHYGSNRLNYFTVSSPIATQLPHAVGAAYSLKMDKKDACAITYFGDGGTSEMKNVQGDFHAALNFAAVMEAPVIFFCRNNGWAISTPTSEQFRSDLYNNLNSTAIAGDGAVIRGQAYGMRSIRVDGNDALAVYSAVHTAREMAIKEGRPILVEALTYRVGHHSTSDDSTKYRPVDEIEHWRTARDPISRYRKWVQGNGWWCDEDESELRNNVRQELLKAIQVAERMPKPPLAELFTDVYDEVPSNLREQERLLRDTIKKHPADYPADVHI

SEQ ID NO: 20810 - protein, 506 aa, Oryza sativa (japonica cultivar-group)
MIAASNFSSSTSTRSSARIRRTNPSLVVERSGWAGCLSGLSCFGSQKGGKRIVPAARVPDGNASTSRGNAHQSGANSNQSAALNLSLLAPPSSPVSFSNSAIPSTAQSPNCFLSISANSPGGPTSNMFAVGPYANEPQLVSPPVFSTYTTEPSTAPLTPPPELAHATTPSSPDVPYARFLLSSMDLKTAGKDHNMPYLSTAYSGGSGLQASYPLYPESPSSSLISPASATPRTGLSSPIPEQEVPTAHWKTSRSACDTPYSRASPIPEQEVCTAHWKTSRSACDTPYSRNSPSNIFGLDSAASRNYMLDNNFFRPAASAQFYLDQAQQSFPYNNGGRISVSKDKQDVEEVEAYRASFGFSADEIVTTQTYVEIPDALDEGFSISPFGNNAPATEVDKSLFNVKVITGPKKSTEQKLSNGSPQNVVHLDIFKGTKGGDVCEDEGMVKDCHPFRKGRDEISLKPIEVRKKVGGGQSCSDAEIEYRRARSLREANGVVSWRSTLARQLQ

SEQ ID NO: 20811 - protein, 816 aa, Chlamydophila caviae GPIC
MSFDKNLVNIETMKQAILNRLYFGVVQSPESASARDIFTAVSKTVMEWLAKGWLKTQSSYYEQDVKRVYYISMEFLLGRSLKSNLLNLGILDLVRDALAELNYDFDSLVQMEADAGLGNGGLGRLAACYLDSMATLGIPAYGYGIRYDYGIFDQKVVNGYQVEAPDEWLRYGNPWEICRGEYLYPVHFYGRVIHYTDARGKEVADLVNTQEVLAMAYDVPIPGYGIDTVNTLRLWQAQSPHGFEFNYFNHGDYIRAIEDIALVENISRVLYPNDSISEGQELRLKQEYFLVSATIQDILRRYTKMHISLDDLPNKVSVQLNDTHPALGIAEMMHILIDREELPWDKAWDMTTRIFNYTNHTILPEALERWSIDLFSRLLPRHLEIIYEINARWLEKVSQRFPGNDDKRKALSIIEEGSDKHVNMANLAVIGSAKVNGVSAFHSQLIKTTLFKDFVEFFPDKFINVTNGITPRRWLALCNPRLNTLLDQTIGDGYLVDLSQVHKVIPFADDANFREQWHQIKLKNKEDFALKLKKEIGEKIDPTSLFDFHVKRIHEYKRQLMNILRVIYLYNDLKENSASSIVPTTVIFAGKAAPGYAFAKLVIKLINSIADCVNNDPQVNEVLKVLFLPNYCVTMSEMIMPASDLSEQISTAGMEASGTGNMKFALNGALTIGTMDGANIEMSEHIGRDNMFIFGLLEEEIAKMRREYYPQGICNNNPKIAHVLKLLDQGFFNTSDKDLFKPIVHRLLHEGDPFFVLADLESYICAHESAATLFTQTDEWVKKSIYNVGGIGFFSSDRAIADYAKDIWNVPTNCKS

SEQ ID NO: 20812 - protein, 240 aa, Halobacterium sp. NRC-1
MQAVVLAAGEGTRLRPLTEDKPKGMVEIAGKPILTHCFEQLVALGAEKIVAIVGYRKQNIISHYGDEFDGVPITYAHQREQNGLAHALLKAEEHVNEDFMLMLGDNIFRANLEDVVNRQQEERADAAFLVEEVDWDEASRYGVCDTNDYGEIQEVVEKPDDPPSNLVMTGFYTFSPAIFQACKLVQPSDRAEYELSDAIDLLIKSGRTIDAIPMEGWRIDVGYPEDRDEAEERIDAVSNE

SEQ ID NO: 20813 - protein, 484 aa, Streptomyces coelicolor A3(2)
MTLLDSAVWGGKFSSDGWQGSPTEQPVTEPATGDRLGTVGLASAEDVNRAAARAAEAQRTWAATSPQRRAAVLRRAGELFTEHAAEIEDWLVREAGSVRSKAAFEAGLAIGECFECAGLPTHPQGEVLTSEDARWSLARRRPAGVVSVIAPFNFPLILGLRSVAPALALGNSVLLKPDPRTAVSGGVVIARIFEEAGLPAGVLHLLPGDGSVGRAVVEAPEVRVISFTGSTPVGRAIGEQAGRLLKRAHLELGGNNALVVLPGADVAKAASAGAFGSYLHQGQICMTTGRHIVHESLVEEYTAALAAKAEALPVGDPAREDVALGPIIDRRQLERVHGIVTDSVAAGAKVAAGGEIDGAGYRATVLTGLTTDMPAWREEIFGPVAPVISFATTEEAARIVNDCEYGLSVGILGDVGTAMKLADRIDSGKVHINEQTVSDEPNAPFGGVKASGTGSRFGGAAANVEAFTETQWLTVRPDIADYPF

SEQ ID NO: 20814 - protein, 538 aa, Campylobacter jejuni subsp. jejuni NCTC 11168
MKNKKIILASFMVLCMLLGILYFKNEPKYIDENLYQSLLSQNLIQKAVIDKDEIWLKAEGENYVIIKDGIDIKTLLSKVPVEVKKDNTLWVFFVLLIFIIALFISLGYFARKKELAKYPISNKNQNHTQAQNSNINLESSHIKPVISNITFNDVAGVDEVKMELSELVDFLQNPKKYKEFGVKMPKGVLMVGPPGVGKTLIAKAVAGEAGVPFFYQSGSSFVEIYVGMGAKRVRELFSKAKMMAPSIVFIDEIDAVGKARGEMSNVERDSTLNQLLTQMDGFEDNSGVIVIAATNKIELMDPALLRSGRFDRRIFLSLPDFKDRLKILEIYMKDKNNNINLNKIAKASVGFSGAGLETLVNEAAINALRRNSALVEESDFYAVLNKVLLGKKKILSFNNEEKKIQATYQAAKALSAYYFDIGFEKITLIEDRFKEYEHNIRSKSELINRIKVYLAGSRAMRLIYNESYTNSQDDFLKIKELLDYMLSFDMLKESNLSEQKKEMDEFLNSMKDKILKLSELLLEKEKIEYDDVKDIMQV

SEQ ID NO: 20815 - protein, 81 aa, Zea mays; identical to SEQ ID NO: 18739

SEQ ID NO: 20816 - protein, 418 aa, Oryza sativa
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNEFMILPTGASSFKEAMKMGVESVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKIEEELGAAAVYAGAKFRAPVEPY

SEQ ID NO: 20817 - protein, 112 aa, Zea mays
  unsure (1)..(112): unsure at all Xaa locations
VAWDDLLMSDPERIKRAVSEYTCNALVLKANQVGTVTEAIEVVKQANDAHWGVMVSHRSGDTEDSFIADLAVGAAAGQIKASVPCRGEXTKYNQLLRIEEELGSEGVYAGEN

SEQ ID NO: 20818 - protein, 492 aa, Nicotiana plumbaginifolia
MDPSKFRPSSAYDSPFLTTNAGGPVYNNVSSLTVGPRGPVLLEDYHLIEKLATFDRERIPERVVHARGASAKGFFEVTHDISHLTCADFLRAPGVQTPVIVRFSTVVHERGSPESLRDIRGFAVKFYTREGNFDLVGNNVPVFFNRDAKSFPDTIRALKPNPKSHIQEYWRILDFFSFLPESLHTFAWFFDDVCLPINYRHMEGYGVHAYQLINKAGKAHYVKFHWKPTCGVKCMTEEEAIRVGGTNHSHATKDLYDSIAVGNYPEWKLSIHIMDPEDVERFDFDPLDVTKIWPEDILPLMPVGRLVLNRNIDNFFAENEQLAFNPGHIVPGLYYSEDKLLQTRIFAYADTQRHRIGPNYMQLPVNAPKCAHHNNHRDGAMNFMHRDEEVDYLPSRFDPCRHAEQYPIPSRVLNGRREMCVIEKENNFKQAGERYRSWEPDRQDRYVSKWVEHLSDPRVTYEIRSIWISYLSQADKSCGQKVASRLTLKPTM

SEQ ID NO: 20819 - protein, 423 aa, Neurospora crassa
MSAKLKPAARVAGNRQDVWTIVNEAAAASPRQPIVNMGQGFFGYNPPEFILNAAKKALDRVECNQYSPTRGRPRLRKALSKAYAPHWGRELDPETEITITTGANEGMLSAFMAFIEPGDEVIVFEPFFDQYISNIEMPGGKIVYVPMHPPKEGHIKTLSASEWTIDFDELERAVTPRTKMLVINTPHNPVGKVFSRAELERIAELCVKNQIIILSDEVYDRLFYTPFTRMATLSPEVEKITLTVGSAGKNFYATGWRVGWLMGPAELIQYVAAAHTRICYSSVSPLQEACAIGFEEADQQGFWTQCIEDMQNKMSRFNAIWDELGLPYSIPEGGYFVMANLNKVEIPEGYPFPPHVAERPRDFKLAWFLIQELGVAAIPPSEFYTDVNAHIVEDWLRFAVCKPDEVLEDAKERLRGLKKFIKQ

SEQ ID NO: 20820 - protein, 802 aa, Ruminococcus flavefaciens
MKKSIFKRYAAAVGLMASVLMFTAVPTTSNAADDQKTGKVGGFDWEMWNQNYTGTVSMNPGAGSFTCSWSGIENFLARMGKNYDDQKKNYKAFGDIVLTYDVEYTPRGNSYMCIYGWTRNPLMEYYIVEGWGDWEPPGNDGVDNFGTTTIDGKTYKIRKSMRYNQPSIEGTKTFPQYWSVRTTSGSRNNTTNYMKDQVSVTKHFDAWSKAGLDMSGTLYEVSLNIEGYRSNGSANVKSISFDGGIDIPDPEPIKPDENGYYLKENFESGEGNWSGRGSAKVKSSSGYDGTKGIFVSGREDTWNGASINLDELTFKAGETYSLGTAVMQDFESSVDFKLTLQYTDADGKENYDEVKTVTAAKGQWVDLSNSSYTIPSGATGLVLYVEVPESKTDFYMDGAYAGVKGTKPLISISSQSVDPPVTEPTNPTNPTGPSVTKWGDANCDGGVDLSDAIFIMQFLANPNKYGLTGTETNHMTNQGKVNGDVCEHGSGLTGDDAVSIQKYLIRAISELPESYLEGHDPSKTTTTTTRITTTTTTTTTTTTSKTTTTTTTTSPAMHGGYRDLGTPMNTSATMISDFRTGKAGDFFASDGWTNGKPFDCWWYKRNAVINDGCLQLSIDQKWTNDKNPDWDPRYSGGEFRTNNFYHYGYYECSMQAMKNDGVVSSFFTYTGPSDDNPWDEIDIEILGKNTTQVQFNYYTNGQGKHEKLYDLGFDSSEAYHTYGFDWQPNYIAWYVDGREVYRATQDIPKTPGKIMMNAWPGLTVDDWLKAFNGRTPLTAHYQWVTYNKNGVQHSSQGQNPWG

SEQ ID NO: 20821 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRTQPAHDAEETAAEPPPAASNGTADGGNKRKAAAMEEEGMLAVMTVAAPESSTKPRLATTSSSLAVET

SEQ ID NO: 20822 - protein, 184 aa, Kluyveromyces lactis
MHTPRLPVLTLVKTPLNKSRMSVLNGLSWVTLKEELTSTKLMKSSPKKPNLLWTAVSRLSLCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 20823 - protein, 467 aa, Gelidium capense
PYAKMGYWDPDYVVKETDVLALFRITPQPGVDAVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEIKGHYMNVTAATMEDMYERAEFAKQLGTVIVMIDLVIGYTAIQTMAIWARRNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGVDVVLQFGGGTIGHPDGIQAGATANRVALEAIVIARNEGRDYVAEGPQILRDAAKTCGPLQTALDLWKDITFNYASTDTADFVETPTANV

SEQ ID NO: 20824 - protein, 297 aa, Corynebacterium efficiens YS-314
MSAPTTNAAPRAKTGYADRFKGGVIMDVVNPEQARIAEAAGAVAVMALERVPADIRAQGGVSRMSDPDMIDGILEAVDIPVMAKARIGHFVEAQVLQSLGVHFIDESEVLTPADYANHIDKFAFEVPFVCGATNLGEALRRVNEGAAMIRSKGEAGTGDVSNAVTHMRTIRAEINRLTSMAEDELYVAAKELQAPYELVVHVAREGKLPVPLLTAGGIATPADAAMMMQLGADGVFVGSGIFKSGNPEQRARAIVAATQNYNDPDTIARVSRGLGEAMVGINVDDLPVSHRLAERGW

SEQ ID NO: 20825 - protein, 499 aa, Glycine max
  unsure (1)..(499): unsure at all Xaa locations
MGKVAVGAAVVCAAAVCAAAALVVRHRMISSRKWSRAMAILKEFEEKCGTPIVKLRQVADAMDVEMHAGLASEGGSKLNMLISFVDNLPTGDEEGLYYAXLDLGGTNFRVXRVHLGGKDKGVIGQEFEEVSIPPNLMTGSSDALFDFIAAALAKFVGSEPEGFHPPXARQRELGFTFSFPVRQTSIASGTLIKWTKGFNIEDAVGEDVVGELTKSMEKIGLDMRVAALVNDTIGTLAGGRFYNQDVIAAVILGTGTNAAYVERAHAIPKWHGLIPKSGDMVINMEWGNFRSSHLPLTEYDLALDAQSLNPGEQIFEKLISGMYLGEVVRRALLKMAEEADFFGDTVPPKLKVPFILRTPDMSAMHHDTSSDLKVVGNKLKDILEISNTSLKMRKIVVELCDIVATRGARLAAAGILGILKKIGRDTVKVGEKQKSVIALDGGLFEHYTKFRECLESALKELLGDEAAETIVIEHANDGSGIGAALLAASHSQYLGVEES

SEQ ID NO: 20826 - protein, 404 aa, Vibrio parahaemolyticus RIMD 2210633
MQDALAVILAGGMGSRLSPLTDDRAKPAVPFGGKYRIIDFTLTNCLNSGLRKILVLTQYKSHSLQKHLRDGWSIFNPELGEYITAVPPQMRKGGAWYEGTADAIYHNLWLLSRNDAKYVVVLSGDHIYRMDYAAMLEEHKEKGAKLTVACMDVPVKDASAFGVMGIAENGLVKSFVEKPENPPTLPDDNAKSLASMGIYIFDMDVLKEALTEDAKLETSSHDFGNDIIPKLIDTESVYAYKFCGSKGRVDKDCYWRDVGTIDSFYEANMDLLEPVPPMNLYQSNWAIRTYEPQFPPARTVSSATGNEGIFINSIIATGVINSGGSVQHSIISSNVRIQDSATVVDSIIFDDVEVGEGSQLVNCIVDKHVRIPPNTQIGINKVEDAKRFKISEKGIVVIPESYQF

SEQ ID NO: 20827 - protein, 359 aa, Salmonella typhimurium LT2
MSTENTLSVADLARENVRNLVPYQSARRLGGNGDVWLNANEFPTAVEFQLTQQTLNRYPECQPKAVIENYAQYAGVKPEQVLVSRGADEGIELVIRAFCEPGKDAILYCPPTYGMYSVSAETIGVERRTVPALENWQLDLQGISDNLDGTKVVFVCSPNNPTGQLINPQDLRTLLELTRGKAIVVADEAYIEFCPQATLTGWLVEYPHLVILRTLSKAFALAGLRCGFTLANEEVINLLLKVIAPYPLSTPVADIAAQALCPQGINAMRDRVAQTVQERQYLVNALQQTACVEHVFDSETNYILARFTASSSVFKSLWDQGIILRDQNKQPSLSGCLRITVGTRQENQRVIDALRAEPV

SEQ ID NO: 20828 - protein, 467 aa, Oryza sativa
  unsure (1)..(467): unsure at all Xaa locations
MDAAMESAVGPHFSGLRLDSRRLSSSSLPPSPSAASSNGCGGNDAPAAVXRVSGGTASGKTTVCDMIIQQLHDHRVVLVNQDSFYRGLTEEESDRVQDYNFDHPDAFDTEQLLECMGQLKSGLSVNIPIYDFKNHRRCSESFRKVNASDVIILEGILVFHDQRVRDLMDMKIFVDTDADIRLARRIRRDTVERGRDVISVLEQYGRFVKPAFDDFVLPSKKYADVIIPRGGDNHVAIDLIVQHIRTKLGQHDLCKIYPNVYVVNTTFQIRGMHTLIRDRDIATPDFVFYSDRLIRLVVEHGLGHLPFTEKQIVTPTGSTYMGVDFCKKLCGVSIIRSGESMENALRACCKGIKIGKILIHRDGDNGQQLIYHKFPLDIAERHVLLMDPVLGTGNSANQAIELLISSGVPEERIMFLNLISAPEGVHCVCKRFPRLKIVTSEIETGLNEEYRVIPGLGEYGDRYFGTD

SEQ ID NO: 20829 - protein, 341 aa, Corynebacterium glutamicum ATCC 13032
MIRADLATIPTYVPGRRLVDATKLSSNEVSFSPLPAAVDAVTEATWGANRYPDMGAVELREALAEHLEVEFDQVTVGCGSSALCQQLVQATCAQGDEVIFPWRSFEAYPIFAQVAGATPVAIPLTADQNHDLDAMAAAITDKTRLIFICNPNNPSGTTITQAQFDNFMEKVPNDVVVGLDEAYFEFNRADDTPVATEEIHRHDNVIGLRTFSKAYGLAGLRVGYAFGNAEIIAAMNKVAIPFAVNSAAQAAALASLNSADELMERVEETVEKRDAVVSALGAAPTQANFVWLPGEGAAELAAKLAEHGIVIRAFPEGARISVTNAEETDKLLRAWEAINAG

SEQ ID NO: 20830 - protein, 244 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAPANSCQLRSDVRLRCRRTGRHRSR

SEQ ID NO: 20831 - protein, 483 aa, Agrobacterium tumefaciens str. C58
MKVVPMHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 20832 - protein, 479 aa, Platyclinia taylorii
RLKNERYESGVIPYAKMGYWDPDYVIKETDILALFRVSPQPGVDPVEASAAVAGESSTATWTVVWTDLLTACDLYRAKAYKVDAVPSTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAASGEIKGHYMNVTAATMEEMYERAEFAKQLGTVIIMIDLVIGYTAIQTMAIWSRRNDLILHLHRAGNSTYSRQKIHGMNFRVICKWMRMAGVDHIHAGTVVGKLEGDPAMIQGFYNTLLLPYLDVDLPKGIFFKQDWASLRKVTPVASGGIHCGQMHQLLDYLGDDVVLQFGGGTIGHPDGIQAGATANRVALESMVIARNEGIDFVKEGPQILRDAAKTCGPLQTALDLWKDITFNYTSTDTPDFVATPTANV

SEQ ID NO: 20833 - protein, 225 aa, Escherichia coli O157:H7 EDL933
MKQYLIAPSILSADFARLGEDTAKALAAGADVVHFDVMDNHYVPNLTIGPMVLKSLRNYGITAPIDVHLMVKPVDRIVPDFAAAGASIITFHPEASEHVDRTLQLIKENGCKAGLVFNPATPLSYLDYVMDKLDVILLMSVNPGFGGQSFIPQTLDKLREVRRRIDESGFDIRLEVDGGVKVNNIGEIAAAGADMFVAGSAIFDQPDYKKVIDEMRSELAKVSHE

SEQ ID NO: 20834 - protein, 498 aa, Glycine max
MGKVAVGAAVVCAAAVCAAAALVVRHRMISSRKWSRAMAILKEFEEKCGTPIVKLRQVADAMDVEMHAGLASEGGSKLNMLISFVDNLPTGDEEGLYYALDLGGTNFRVLRVHLGGKDKGVIGQEFEEVSIPPNLMTGSSEALFDFIAAALAKFVGSEPEGFHPPPGRQRELGFTFSFPVRQTSIASGTLIKWTKGFNIEDAVGEDVVGELTKSMEKIGLDMRVAALVNDTIGTLAGGRFYNQDVIAAVILGTGTNAAYVERAHAIPKWHGLIPKSGDMVINMEWGNFRSSHLPLTEYDLALDAQSLNPGEQIFEKLISGMYLGEVVRRALLKMAEEADFFGDTVPPKLKVPFILRTPDMSAMHHDTSSDLKVVGNKLKDILEISNTSLKMRKIVVELCDIVATRGARLAAAGILGILKKIGRDTVKVGEKQKSVIALDGGLFEHYTKFRECLESALKELLGDEAAETIVIEHANDGSGIGAALLAASHSQYLGVEES

SEQ ID NO: 20835 - protein, 630 aa, Oryza sativa
MAGGAMTDTDGAHKNYPGKMTIFVFLACLVASSGGLIFGYDIGISGGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKAICMTRLRPAPTKRLQYQCSPQILSISSMGIPLVSGRKTKTNPVMISSMAPKKKKSPNLRRHSIIRKICAMKKVNAMLNTTTTLCAADLISSGKISLGTSHPRGPHDHANADTNRQMNSTTTMA

SEQ ID NO: 20836 - protein, 474 aa, GIBBERELLA ZEAE PH-1
MGNNTSSSSKPTTPTTSAPGSAHGGHLHGHESPRHHLRKDARNIITGHTHRSAAPPEPSMAQAQGSTVINRPKSLPPTAVSSLSGSPHNNFTAVHKTASSSDAKAIAEKQGTATPESKSHHRDEPTKPLDVPMESSSLRSHQSAHVHDSALIPNSSITDMYLTRPPRLPLPIDEEVHTPGSPILAPENDQEGDMEPIDSLDGITRKSSALSATTVDEEDGEELRVDKTRPVVQTKLEWLSGGDKVYVTGTIFQWNRKQRLHPIEGRPGCFSTSVYVLPGTHHVRFLVDGIMQTSPDLPTTVDFGNNLVNYIEVSPEDAQKVPAPSAAAYAEAQAAAAAQATAQAQGLAPGAPKPPPQLKGKPVPPPESYRSQIPKYLIDFDQAEDSQAYQYAVNAIERLPNPPALPGFLSKPILNAATLMKDDNSVLNMPNHTILNHLATSSIKNNILAVSATTRYRDKYVTTIVYKPTASDES

SEQ ID NO: 20837 - protein, 486 aa, Schizosaccharomyces pombe
MTATKEESQKLLTSLRSQRDNKVCFDCGAKNPTWSSTTFGIYLCLDCSAAHRNMGVHISFVRFLRSTVLDSWTYAQLRVMRVGGNENARNYFKRHGGVSLLNSKDCRLKYSSKTAKQYLEKLKSLAVEDEANYPDILDMDFLSNTHEGSSAADTTNEDDDFFSAWDKASVKKSDDNLDDKTDLASTSSSVVVESGEKDEPVVVTEEKTMVSPPSRPDSTSTTKSKTSSISSARARPIRASSRPTASKLGASRPQKLGIKKANADIDFDEFEKAVLSSESAPTKKPAAVASKESTVDTLVDNGVEEVKESTSTTVQGKPVKPVLKSAASAKSTKSDDSNLNANFARLGFGQFAAASNARAKAAAKARELKKNEVNAPTYARDHFASQKSISSDQYFGRGSFDPEAAAEAQERLSSFRDATAISSKSYFGEEEDENEEGESSHRPDSAYLRDIAETATEDIEAIKVAIHQGAEKLSDFIQKVGARYNF

SEQ ID NO: 20838 - protein, 602 aa, Shigella flexneri 2a str. 2457T
MSLAANCLSKIGRLMCFTHFFRQTVRQAMEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVCPESVSMRSYNPTTTGHKGQIKRALQTLVAAKKPVVYVGGGAIMAGCHQQLKETVEALNLPVVSSLMGMGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRALQCLKYDTHSEKIKPQAVIETLWRLTNGDAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPHELESKLSEALEQVRNNRLVFVDVTVDGSEHVYPMQIRGGGMDEMWLSKTERT

SEQ ID NO: 20839 - protein, 153 aa, Zea mays
  unsure (1)..(153): unsure at all Xaa locations
MASSMLSSAAVVTSPAQATMXRXPFTGLKSSSAFPVTRKANNDITSIVSNGGRVSCMKVWPPVGKKKFETLSYPXLTXTEXELGKEVDYLLRHXWIPXCVEFELXHGXVYREHGSTPXYYDGRYWNNGGSFPLVRMALPLPGLKGSRGQNGVP

SEQ ID NO: 20840 - protein, 894 aa, Musa acuminata
MNSVRSGFLIQAAFLVMISGSSNMGVSGLGSMSSIAVSYGENGPVFCGLSSDGSHLVACFGADASIVYGAPLRLPLLGLTAGDGFVCGLLLDTGQPYCWGSNIFVKMGVPQPMAEGASYSEISAGDDHLCALRKPAIDSRKGASLIDCWGYNMTASHEFDGSVAAITAGSVFSCGMFIHNRTAFCWGDETSSGVISLTPRNLRFQSISAGGFHVCGILENSQVFCWGRSLETQQLSLGHGDVKMVPMDPMVSVAGGRFHACGIKSLDHKAVCWGFMLQNSMPPPKDSRLYEIAAGDYFTCGVLAATSLRAVCWGTGVPWSIPMAVSPGICASNPCGQGYYEFSHTSWGNKVCKPADSRVCLPCSVGCPEGTYESTPCNLTSDHGCEFNCSSCASVECSSFCSSQKESKSKRLLSLQMPIFIAEIVFAIIFVSSVFLVACLYARHRLQSCRCLESAVTTSRKRTYSFHKEMVKVRPDLEELKIRRAQMFTYGELEKATSGFSEESLVGKGSFSCVFKGVLKDGTVVAVKRAIRVSDVKKNSKEFHTELDLLSRLNHAHLLNLLGYCEEGGERLLVYEFMAHGSLYRHLHGKDLCLRKRLDWVRRVTIAVQAARGIEYLHGYACPPVIHRDIKSSNILIDEEHNARVADFGLSLLGPVDSSSPLSEPPAGTLGYLDPEYYRLHYLTTKSDVYSFGVLLLEILSGRKAIDMQFEEGNIVEWAVPLIKAGDISAILDPVLKPPADLEALKKIAAMASKCVRMRGKDRLSMDKVTTTLERALALLMGSPCNEQPILPTEVVLGSSRLHNKASQRSSNRSCSENDTDDQIYEYRAPSWITFPSVTSSQRRKSSASEGDAEGKNSEGRSLGHGGAGDGLRCLEEEIGPASPQENLFLQHNF

SEQ ID NO: 20841 - protein, 573 aa, Yersinia pestis CO92
MKQTVATLIAKTLEQAGVKRIWGVTGDSLNGLSDSLHRMGTIEWLGTRHEEVAAFAAGAEAQLTGQLAVCAGSCGPGNLHLINGLFDCHRNHVPVLAIAAHIPSSEIGSGYFQETHPQELFRECSHYCELVSNPEQLPRVLEIAMRQAILNRGVSVIVLPGDVALQPAPEDAAVIWQTPKLPLVQPPMSELTLLADTLNKAKNITLMCGSGCADAHDEVVKLAERLQAPVVHALRGKEHIEWDNPYSVGMTGLIGFSSGYQAMLNADTLILLGTQFPYRAFYPTHANIIQIDINPGSLGAHCPVNMALVGDIKTTLTALLPQLDAKSDRAFLDKALEHYRTTRQDLDALATANDNQPIHPQYLAQQISHYATEDAIFTCDVGTPTVWAARYLQMNGKRRLLGSFNHGSMANAMPQAIGAQATAPDRQVVALCGDGGFTMLMGDFLSLTQLKLPVKIVVFNNSVLGFVAMEMKAGGYLTDGTDLHNPDFAAIANAAGIKGIRVEKASELNAALESAFAHPGPVLVDVVTAKQELSMPPQIKFEQAKGFSLYMLRAIINGRGDEVIELAKTNWLR

SEQ ID NO: 20842 - protein, 396 aa, Helianthus annuus
  unsure (1)..(396): unsure at all Xaa locations
MAXRIXXATFQSDLYRSFAFPQPKPLRSPKFAMASTIGSATTKVESTKKPFTPPREVHQQVLHSMPPQKIEIFKSMEGWAEDNILVHLKPVEKCWQAQDFLPDPASDGFMEQVEELRARAKEIPDDYFVVLVGDMITEEALPTYQTMLNTLDGVRDETGASPTSWAIWTRAWTAEENRHGDLLHQYLYLSGRVDMRQIQKTIQYLIGSGMDPRTENSPYLGFIYTSFQERATFISHGNTARHAKEHGDVKLAQMCGIIAADEKRHETAYTKIVEKLFEIDPDGTVLAFADMMRKKISMPAHLMYDGRDDNLFENXSAVAQRLGVYTAKDYADILEFLVGRWKVADLTGLSGEGRKAQDYVCGLAPRIXRLEERNSARAKERVNVPFSWXLNREVKL

SEQ ID NO: 20843 - protein, 360 aa, Oryza sativa; identical to SEQ ID NO: 5253

SEQ ID NO: 20844 - protein, 72 aa, Oryza sativa
  unsure (1)..(72): unsure at all Xaa locations
LTKMREADAGLSAITDSAKSGPITLPGRYLSGKQEHVXWAKIHTSTDXVAGPYDSLVAPPDDLQETNTMLNK

SEQ ID NO: 20845 - protein, 163 aa, Zea mays subsp. parviglumis
EEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVG

SEQ ID NO: 20846 - protein, 565 aa, Xylella fastidiosa 9a5c
MAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLALAFALAAILSPTDPVALSSITSRVRIPKRMMHILEGESLLNDATGLVCFQFAIAAVLTGHFSLATASLTFVWVLVVGLSLGMTTTYVLSRVQRWVWRHFGGEPAAAILVNLLTPFAAYLLAESMQASGILAAVAAGITMSYVELSGNAPATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 20847 - protein, 688 aa, Oryza sativa
MAEHRGGRAFSNFFLADCRVGQKARNSARASEPKMTNTTPCNFFTDNECDSSDDVAVVVCVVNFFYAFSDCFLADNECDSGDDVAAVDSKPARTDATNRPKPPGIVQVSDSYLHKTVLNMSKTGIRYPNKLLLHLTKQPERRIQITIAELYCPSYYRMHAALLPTDNTVFSQDKMSPRCGASPEHRPEYTRTTYSTYGREAATMLWKRSTWSTADESAAANITKYHTKTKPNRRKRDTAVLGAKRERRLRRDTRAMEAAVDGRWTRVRTLGRGASGAVVSLAADDRSGALFAVKSAAAAAAAEQLVREGRVLSGPRAPLVLPSRGVPAGAGPECPLRLVSAPAGALADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPGVPEWLSAEAKDFLARCFARNPRERWTSSQLLEHPFLASAGCSVKTGEAAPQWVSPKSTLDVAFWESDTDDEEDDMPASPAERIKALACPCSPLPDWDSDEGWIQVLNESSEACDTAVAKVEAEGKGRVLIEALETINESSGGDAECVDPEGTVRLITVASIGQQEVFCLGLINDPLVFSVNKSSSVKLQCAFLDVYCTLAALPVIRSSEIR

SEQ ID NO: 20848 - protein, 398 aa, Glycine max
MSLTLQTPPSTTLSSASPIHRTITRYTTFSFSLRPPTTLHFNPHRSLPLIRASNSSINAASTTELDAVSAFSEIVPDTVVFDDFEKFPPTAATVSSSLLLGICGLPDTIFRNAVEMALADSECYGLENPNARLSCFVNKAFANIGSDMAKLVPGRVSTEVDARLAYDTHAIIRKVHDLLKLYNDSNVPPQRLLFKIPSTWQGIEAARLLESEGIQTHLTFVYSFAQAAAAAQAGASVIQIFVGRIRDWARNHSGDTEIESAQLRGEDPGLALVTKAYNYIHKYGHKSKLMAAAVRNKQDLFSLLGVDYIIAPLKVLQSLKESVASPDEKYSFVRRLSPQSAAKYTFSDEELVRWDEDSLSKAMGPAAVQLLAAGLDGHADQAKRVEELFGKIWPPPNV

SEQ ID NO: 20849 - protein, 787 aa, Triticum aestivum
MTTDQPVISLRPGGGGGGPRGGRLFAPAFAVAASGSGDFLRPHGGGAFRALQDWCLHLSHERVRYSRDQLLDLRKITDVTEQILRLQQEIEAELHGDDQSWVRNDSNVQLQTQTQTQVQAQNRFTETDNRDWRARTEKPPAPAVPEEKSWDNIREVKEQYNASGRQQEQFNRQDQSSSQKAQVGPPPALIKADVPWSARRGNLSEKDRVLKTVKGILNKLTPEKFDLLKGELLDSGITTADILKDVISLIFEKAVFEPTFCPMYAQLCSELNDNLPKFPSEEPGGKEITFKRVLLNNCQEAFEGADSLRVEIASLTGPDQEMEKRDKERIFKLRTLGNIRLIGELLKQKMVPEKIVHHIVKELLGSDKKACPDEEHVEAICQFFNTIGKQLDENPKSRRINDTYFVHLRELVANPQLTPRSKFMVRDLIDLRSNNWVPRRAEIKAKTISEIHTEAEKNLGLRPGATANMRNGRNAPGGPLSPGGFSVNRPGTGGMMPGMPGSRKMPGMPGLDNDNWEVQRSRSMPRGDPLRNQGSLINKVSSINKPSPINPRLLPQGTGALIGKSALLGTGGPPSRPSSITASPTPLPAQTTASPKPSSATPASVPIPDKAASSAKVIPAGLEKKTASLLEEYFGIRILDEAQQCIEELQSPDYHPEIVKEAINLALDKGASFVDPLVKLLEHLYTKKTFKTEDLENGCLLYGSLLEDIGIDLPKAPTQFGEVIARLILSCGLRFEAVEGILKAMEDTFFRKAIFTSVTKTLEADPAGQAILSSHAAVVDACNSLSI

SEQ ID NO: 20850 - protein, 199 aa, Dichelobacter nodosus
MLLIIDNYDSFTYNLAQYFMELGEQILVEKNDAITPVDIENLAPTAIVISPGPCSPKEAGISNAVIAHFAGVIPIFGVCLGHQCIAEVFGGKVVGAHQVCHGKVSPVCHHHGGVFRHLPNPLTVARYHSLVVDKDSLPKAFEITAWIEDDRENVIMGIRHKTLPIEGVQFHPESFLSEAGHDLLKNFLMDVQVFNRENV

SEQ ID NO: 20851 - protein, 344 aa, Photobacterium profundum
MMQGLYMPNMKTLGEFIVEKQNDFPHASGDLSSLLGSIKLAAKIVNREINKAGLVDITGAIGSENVQGEEQQKLDLYANDKFKAAMEARDQVCGVASEEEDEAVTFNKDLNRNAKYVILMDPLDGSSNIDVNVSVGTIFSIYRRVSPIGTTPTQDDFLQPGNQQVAAGYVIYGSSTMLVYTTGNGIHGFTYDPSLGVFCLSHENMQIPEDGQIYSINEGNYIRFPQGVKKYIKFCQEDVPADNRPYTSRYIGSLVSDFHRNLLKGGIYMYPSTAMYPNGKLRLLYECNPMAFLMEQAGGVASDGKNRILDITPTELHQRVPFFVGSTNMVKQVESFIEEYPEQH

SEQ ID NO: 20852 - protein, 336 aa, Shewanella oneidensis MR-1
MTIRVAINGYGRIGRNVLRALYESEKAYPIKIVAINDLGDASINAHLTKYDSVHGRFNAKVEHDAEAIYVNGDKILTFQERDPGKLPWNDLQVDVVFECTGIFTSKESVQPHLAAGAKKVIISAPGKNVDATVVYGVNNNVLTSDMTVISNASCTTNCLAPFAKPLNDEIGIESGLMTTIHAYTNDQRLSDVYHTDLRRARAAALSMIPTKTGAAAAVGLVVPELQGKFDGLAVRVPTVNVSLVDLSFIASRDTTVEEVNAIIERAASVAPLSEVLAVNKEPLVSIDFNHNAFSSNFDATQTRVNGRLVKVMAWYDNEWGFSNRMLDNAVALMNAK

SEQ ID NO: 20853 - protein, 666 aa, Streptomyces avermitilis MA-4680
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 20854 - protein, 346 aa, Glycine max
LEPLGVVGHITPWNFPNTMFYIKVAPSLAAGCTMVLKPAEQTPLSALFNAHLAKLAGIPDGVINVVPGFGPTAGAALSSHMDVDKVSFTGSTQTGREIMQAAAKSNLKQVSLELGGKSPLIIFDDADIDKAAELALLGILYNKGEVCVASSRVLVQEGIYDEFEKKLVEKAKAWVVGDPFDPKVQQGPQVDKEQFEKVLSYIEHGKKEGATLLTGGKTVGNKGYFIEPTIFSNIREDMLIAQDEIFGPVMALKKFKTIEEAIKSANNTKYGLAAGIVTKNLDTANTVSRSIRAGTIWINCYFAFGDDVPFGGYKMSGFGKDHGLEALHKYLQVKSVVTPLYNSPWL

SEQ ID NO: 20855 - protein, 157 aa, Triticum aestivum
MAGMVFGLDAPMMAALQHLLDIPDGEAEPPPEKQGPTRAYVRDARAMAATPADVKELPGAYAFVVDMPGLGSGDIKVQVEDERVLVISGERRREEKEDAKYLRMERRMGKLMRKFVLPENADMEKISPCRDGVLTVTVDKLPPPEPKKPKTIQVQVA

SEQ ID NO: 20856 - protein, 204 aa, Triticum aestivum
MAGQGSYSRLAADEAAAVISGGGGDDYDSKKLRLLGYEPQLKRNLSLLSNFSVTFSIVSVLTGITTLYGTGLQFGGPVTMVYGWPIAGAFTTVVGLAMAEICSAYPTSGGLYFWSARLCSERRWGPFASWLTGWFNLVGQGAVTTRVDLSLAQLIQVIILLSTGGNNGGGYKFTCLLFVTCFILDTNYCRHVVSNLSSLHFFFI

SEQ ID NO: 20857 - protein, 467 aa, Cryptopleura ramosa
PYAKMGYWDPHYVIKETDVLALFRVSPQPGVDPVEASAAVAGESSTATWTVVWTDLLTACDLYRAKAYKVDAVPNTTDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLLPYLDINLPQGIFFTQDWASLRKVTPVASGGIHCGQMHQLLDYLGNDVVLQFGGGTIGHPDGIQAGATANRVALEAMVIARNEGVDYVAEGPQILLDAAKTCGPLQTALDLWKDITFNYTSTDTADFVETPTANV

SEQ ID NO: 20858 - protein, 249 aa, Zea mays; identical to SEQ ID NO: 2479

SEQ ID NO: 20859 - protein, 178 aa, Glycine max; identical to SEQ ID NO: 6669

SEQ ID NO: 20860 - protein, 385 aa, GIBBERELLA ZEAE PH-1
MVSAWSKIAMAASLAASVTAQTYTSCNPMKKSCDPDVGLAASSYTVDFTKGADDDNWEGTGHGDVKYTSDGAEFTIDKEGQSPTIQTKWHMFFGRLEVHLKAAPGQGIVSSIVFLSDVLDEIDWEFLGGRPNEAQSNWYAKASTDNTQSLTFPVDNAQADFHNYTVHWTSESIEWYIDSTKVRTLAYPSGGVNYPQTPMRIKLGIWAGGDPTNAEGTIEWAGGETQYQDAPFTMTVQKVMVQNLNPADSYTYGDETGSYKSIKFDKKDNGSDDEDKDEDKDETESTTASTTASKTDSKTTESATETATATDSDSESTTMSTARSSETGSSDFKNNKAEETSGSETGTSTGSSASSTAKSDENSASGNMPKMWLSLGVLCGAMLLL

SEQ ID NO: 20861 - protein, 255 aa, Glycine max
  unsure (1)..(255): unsure at all Xaa locations
MAGELGVLNALDVAKTQWYHFTAIVIAGMGFFTDAYDLFCISLVTKLLGRLYYTEPGAPKPGTLPPRVQASVTGVALCGTLAGQLFFGWLGDKMGRKKVYGLTLILMVVSSLASGLSFGSTAEGVMATLCFFRFWLGFGIGGDYPLSATIMSEYANKKTRGAFIAXAVFAMQGFGILAGGVVALIVSYAYDQKYKLPSYAQNPEASLDPSFDYVWRIVLMFGAIPAALTYYWRMKMPETARYTALVAKNAKQAAA

SEQ ID NO: 20862 - protein, 197 aa, Sporobolus stapfianus
MGGGKDKHDESDKGLFSNLMHGVAGGHGYPPHGYPPQGYPPQPGAYPPPPGAYPPPPGAYPPPPGAYPPPPQHGYPQHGGYPQHGGYPPSGYPGGSHQGGHSSSHGGGNMGLLAGGAAAAAAAYGAHKLSHGHSGGHGFPGGHGGYAVGGYGHGYGGHGKFKHGHGGHGKFKHGHGKFKHGKHGHGMFGGGKFKKWK

SEQ ID NO: 20863 - protein, 179 aa, Helicobacter pylori J99
MNEMLKEELLQSIREVKDYPKKGILFKDITTLLNYPKLFNKLIDALKKRYLALNIDFIVGIEARGFILGSAFAYALGVGFVPVRKKGKLPAHTLSQSYSLEYGSDSIEIHSDAFRGIKGVRVVLVDDLLATGGTALASLELIKALQAECIEACFLIGLKELPGIQLLEEHVKTFCLLEC

SEQ ID NO: 20864 - protein, 454 aa, Gracilaria sp.
VKDTDVLALFRVSPQPGVDPVEASAAVAGESSTATWTVVWTDLLTACDLYRAKAYKVDAVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEGVNRSIAATGEVKGHYMNVTAATMEDMYERAEFAKQLGTVIVMIDLVIGYTAIQTMAIWARRNDMILHLHRAGNSTYSRQKIHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 20865 - protein, 492 aa, Pseudomonas putida
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALVEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAGDVTILPHNLSEALEVLETSKFFREAFGEEFIRYWMHLRRSEWKRFVDAEGQVDFSGDPVTNWEHREYFELF

SEQ ID NO: 20866 - protein, 462 aa, Thermosynechococcus elongatus BP-1
MVKLTPTPAYSLTLRLETSLDPTELGTVLQIIGGQQGQVGSIRLLEKTANRILRELVVVAASQEHGQAIVNAVKSDGQATVLEVSDRTFRLHEGGKITIKSKHPLQEYDDLAMAYTPGVGRVSQAIADDPDLVHKLTIKSHTVAIVSDGSAVLGLGNIGPEAALPVMEGKAMLFQEFAGLDAFPICLATQEVDEIVATVKRIAPVFGGINLEDISAPRCFDIEARLQAELDIPVFHDDQHGTAIVTLAALKNALQFVGKSLETVRIVINGAGAAGIAVARLLRKAGAKDLILCNRRGILSLQTDLTPAQKEFAVTQTGTLADALGDADVFIGLSAPGVLTVEMVQRMAKEAIVFAMANPVPEIQPELIYNHVAVVATGRSDYPNQINNVLAFPGVFKGTLACRAPRMTEEMFLAAAEAIAGLVSPSERHSAYIVPSVFDPRVAPAVAKAVEDCARSLGLARA

SEQ ID NO: 20867 - protein, 519 aa, Oryza sativa
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 20868 - protein, 227 aa, Zea mays
RSPNRPLLSFRRVLLRPRSHDFGQIAEANLNIDALCMAFYARSEETRQSHSVHKLALGTLALEHALSSGSPIRSEVELLRKSVEGIDKDSLLELAVSSLPEDVLDYGSDTRMGLKQQFNSLKETIRHLSLLPAGGGGILAHAVARVASSIKIKGDNSGDGIESLINKVESMIVNGDLSTAADALEQGLHGTEAEEIATEWVKQARKRALAEQTLALLRACASSTTFS

SEQ ID NO: 20869 - protein, 505 aa, Paracoccus pantotrophus
MKVRAQIGMVLNLDKCIGCHTCSVTCKNVWTSREGVEYAWFNNVETKPGIGYPKDWENQRRWNGGWVRTRCGHLRPKQGGKWRILANIFANPDLPEIDDFYEPFDFDYDHLKSAPEMQAFPTARPRSKISGERMEKIEWGPNWEEILGGEFEKRSKDYNFEGIQKDIYGEYENTFMMYLPRLCEHCLNPACVASCPSGAIYKREEDGEELIDQDKCRGWRMCVSGCPYKKIYYNWSTGKSEKCILCYPRLESGQPTVCSETCVGRIRYLGLMLYDADKIAEAAASESEMDLYDAHVGVFLDPNDPEVIAAARAEGVPEDWIKGAQKSPIWKMAMEWKIAFPLHPEYRTLPMVWYVPPLSPIQNAAEGGKIAAQDDMPDVRSLRIPLRYLANMLTAGDEAPVAAALERMLAMRTNMRSKTLDGVVNLGVAKRVGLTPQQIDEMYQLLAIANYEDRFVIPTTHREIVEDAYDLRGGCGFTDGHGCSSGDTPSLFGGKKFRSPQEFIA

SEQ ID NO: 20870 - protein, 351 aa, Thermoanaerobacter tengcongensis
MIENLLREEIKGFKNYEVENVPYKYKMDANETPFELPEEVMKNIGDIVKSIHVNIYPDPTAEKLREELARYCSVTPKNIFVGNGSDEIIHLIMLAFVDKGDTVLYPHPSFAMYSIYSKIAGANEIAVNLNEDYTYNVERFAEAVERYKPKLVFLCNPNNPTGSVIDEEDIIRIIEKARGIVIVDEAYFEFYGKTLVPYIDRFENLIVLRTLSKAFGIAGLRVGYALSNGEIVKYLNLVKSPYNLNSLSQRIALEVLKSGVLKERVNYIINEREKLVKELNKINGIKVYPSHANFVLCKFENANDVHKRLVERGILVRNFSNVKGLEGTLRITVSSSDANDYLINALREILS

SEQ ID NO: 20871 - protein, 64 aa, Arabidopsis thaliana
MRSILIDWLVEVHVKFDLSPETLYLTVNIIDRFLSLKTVPRRELQLVGVSALLIASKYEEIWPP

SEQ ID NO: 20872 - protein, 152 aa, Pisum sativum
MDLDSPLFNTLHHIMDLTDDTTEKNLNAPTRTYVRDAKAMAATPADVKEHPNSYVFMVDMPGVKSGDIKVQVEDENVLLISGERKREEEKEGVKYLKMERRIGKLMRKFVLPENANIEAISAISQDGVLTVTVNKLPPPEPKKPKTIQVKVA

SEQ ID NO: 20873 - protein, 510 aa, Gossypium hirsutum
MPSFDTILLRDLVAAACLFFITRYFIRRLLSNPKRTLPPGPKGWPIVGALPLLGSMPHVELAKLAKKYGPVMYLKMGTCNMVVASTPDAARAFLKTLDLNFSNRPSNAGATHIAYNSQDMVFAEYGPRWKLLRKLSNLHMLGGKALEDWSQVRAVELGHMLRAMCESSRKGEPVVVPEMLTYAMANMIGQVILSRRVFVTKGSESNEFKDMVVELMTSAGLFNIGDFIPSIAWMDLQGIEGEMKKLHNRWDVLLTKMMKEHEETAYERKGKPDFLDIIMDNRENSAGERLSLTNVKALLLNLFTAGTDTSSSIIEWALAEILKNPKILNKAHEEMDKVIGRNRRLEESDIPKLPYLQAICKETFRKHPSTPLNLPRVSTQACEINGYYIPKNTRLSVNIWAIGRDPDVWGNPLDFTPERFLSGRFAKIDPRGNDFELIPFGAGRRICAGTRMGIVLVEYILGTLLHSFDWMLPPGTGELNMDEAFGLALQKAVPLSAMVRPRLAPTAYVS

SEQ ID NO: 20874 - protein, 133 aa, Salmonella enterica
GSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLY

SEQ ID NO: 20875 - protein, 252 aa, Triticum aestivum
  unsure (1)..(252): unsure at all Xaa locations
MMGYQKGVDIEAGTSGGTGTAAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLXALLTLFRAGDS

SEQ ID NO: 20876 - protein, 314 aa, Triticum aestivum
MASDGVVALYGNNKAVVEPSAKPAAATFSVKVGLAQMLRGGVIMDVVTAEQARLAEEAGACAVMALERVPADIRAQGGVARMSDPALIRDIKRAVTIPVMAKARIGHFVEAQILEAIGVDYVDESEVLTLADDAHHINKHNFRVPFVCGCRDLGEALRRIREGAAMIRTKGEAGTGNVVEAVRHVRSVMGAVRALRNMDEDEVFSYAKQIAAPYDLVMQTKQLGRLPVVQFAAGGVATPADAALMMQLGCDGVFVGSGIFKSGDPARRARAIVQAVTHYSDPEILANVSAGLGEAMVGINLSDPNVERFAARSQ

SEQ ID NO: 20877 - protein, 272 aa, Arabidopsis thaliana
SSKWDEVTADVLKALEDYGCFEAFFDKLSVELNRSVFEAMEDLFELPIPTKQRNVSSKPFHGYLCHNLYESLGINDANVLEKVNDFTQQLWPDHGNKSISETIHLFSEQLVELDLMVRRMIMESFGIENYIDEHLNSTYYLTRLMKYTSPPDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDF

SEQ ID NO: 20878 - protein, 459 aa, Streptococcus pyogenes MGAS8232
MSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 20879 - protein, 332 aa, Gluconobacter oxydans
MRIGIIGLGRMGGNIAVRLTRHGHDVVVHDRTSEVTTSVVGRCEAGRATPADTLADMAKLLEGDEHRVVWVMLPAGAITEDCVQQLGGLLGRGDIIIDGGNTYYKDDVRRSAELAEKGISYVDVGTSGGVWGLERGYCMMFGGTKETAEYIDPILSALAPGIGDVPRTPGRDEAGHDPRAEQGYLHCGPAGSGHFVKMVHNGIEYGMMQAFAEGFDIMKSKNSPILAEKDRFELNMGDIAEVWRRGSVVSSWLLDLTAEALTRSETLNEFSGEVADSGEGRWTIEAAIEEDVPAPVMTAALFTRFRSRSGNNFAEKILSAQRFGFGGHVEKK

SEQ ID NO: 20880 - protein, 107 aa, Eremothecium gossypii
MSRHQFDLVMCMKLPGTSIGRLCERCDGKCPSCDSNVRPLSKVRICDQCSFGGQGKKCILCGSIGVSDAYYCWECCKLEKDRDGCPRILNVGSNKTDRHFDRKLTER

SEQ ID NO: 20881 - protein, 387 aa, Enterococcus faecalis V583
MEFLGILCLILITTTLAGVACKRVGIPAVIGQLLVGIVLGPAMLNIVHQDVFVHDFSEIGVIMLMFIAGMECELELLKKYAKPSVMVAILGIVLPVGFTMLIGQLFAFSWKEAFFLGLVLAATSVSISVEVLRELNVLSSKEGATILGASVVDDIVVVIILSVAVGMIGASTGGNTEVSFIVKLIEQGLFFIGIFFLVRFIAPYLLRLSQKMNIGSSVIIMSLIICLGMAYLADLVGLSSVVGAFFAGIAVGQTDAKTEIDFNIEAIGYAVFIPVFFASIGLSVTFNTLGKDLPFILVMTIMAILTKLLGGAWGAKMVGFSNTSSLMVGAGMVSRGEMALIIAQIGYQSKLLSEAYYTSMIVVIILTTLVAPFLLKYFVKKQESALQ

SEQ ID NO: 20882 - protein, 319 aa, Archaeoglobus fulgidus DSM 4304
MVKLASNENPYGPSPKAIEAFRSYSDLHIYPNPEYRELREKISDYTGWDADRVVVGAGIDGILETLFRILIDEGDEVVIPIPTFPYYHILTKLSCGKEVLVRRGENYRIDESIFDAITQKTKIILICNPNNPTGNAEDAKLIEELVNSTNALIFLDEAYVEFSDVSFSVDAENVVIARTFSKAFGLANLRIGYALLPEWLVSPFRAAMTPFPLSTPAAKAAEAALDDVEWMRSCVGRIKAERERLYKELKKLVEVNLSQANFLFFESPVENLAEELLKRGVIVRDCSSFVGCGNHIRVTVGRPEENDMFLEALKEVLGC

SEQ ID NO: 20883 - protein, 1666 aa, Chlamydomonas reinhardtii
MYWYDYAWILVVGCLAAFFTAFGIGANDVANAFGSSVAARTLTLRQALLIASVCEFSGSVLLGREVTRTVAGGIARLTAFDRAPELYMFGMLCALTASGVWLLLATYLSLPVSTTHSTIGAVMGFALVYGGPGAVVWLDEQSSFPYMGGLVPIILAWFTSPLLSGLATVCMFSSVRTGILRRENSLMMAFWSLPLLVLGTVFINAFLVLYNGANESRLHWPASRAAWVSACIAGGACLLTVLVAMPLVRRRVLLRQALVRDLALRRRQQLAYYVTRGSNAGKDTPAPTPAPGRSLGPYGSDSGPVPSAQHAGRSRSSTAGALGGTRGATGGGGGHGSGLVDGGADSPAQGFARHADLGPTAAAMGMGAAGAAFPLAAGMDPGLLLPVPAPSGHQQHSSQPPSGGGAGGGLGGGVPPPMERQTSGGLRRSDTSSAYAAAPPPPQQQQAAGAGAAGDAGMQAGTGDGPAMMSPLLSPYHPQHQQAPPMLPAATAAAAAGSRYDSTRSLLPVRGGDGVAAAAAGPGTGGGGGSAASERLGPQALHLPQQQSQPYARLTPDLVRVTSTGRTSSTVTTATTTHSGGITPPQFQQPSQLSSAQHSSAHTKLTAGGSGGPLGPQGQLSLQLQGSTHGSSGRDNGGDTSSAASGGAAAGAIGGGGGGGCGGSVEMVAQPAGAAAAGAAGVGGEGQQQVQAAAAAAEAGRAVPIAADEGAAGAGAGAGTAGVAVTAATGAIGAEAQAGQLQQQAQQAWAGPQQQQQQQQQQQQQWPQQAQWSQPQQQHQAWGNQQQQWSAQQQQAWGGQQEQQPQQQWNNQQQWRGQQQAWGNQPQQQQAWGNHPQQQQQQQQQPQQWSQQQQWNQQQQWGQQQWNQQQNQWAAGQPQQQMQQQRWMQSQQPQLQQQQRNYAATQQAQAQPQQQWGGQNPYWQQQQQPPLQQQQYGQQGNHLSRAAYQAQPQQPQQQRGWGPGAPAGGGAVAFRPPQASVQPQQQWGGGGMGVGGMHMQRPQPPRFGGAGAGAGAGGFYNPQAGSAAYGGGGGGFVALPAGPQLSGRYAHGAPGPIAEATARRRSMGDGAGQEGPVEEIQWVEAEGTEGRGRGVGAQEEMEPQAAAAHSPLPPPPPPRPPGQQHKSLTAAVLGGAAVVAARALGRRSDPAAMASFHSMQYSRPTAESFERETVVDAAAGSGDGHGEGWGGGRGGGGAGGGWDDSHHDHPLSSAPHPHVFDDAEYDQRSDDHVPLDPLHGGSSANAGGGVMPAPSMGRGSGSAGGGGGGMGSRASRSYAAAAAAAQYGFHMPFSHHSHSAAQHGAGTDGGGGGGGVEAGDGSGQGLPPGAAAGTHWQKTFDQLKAVVMRGANDDAFHAEVLEHDQVAAGMHARAEVFDPATEHAFKYLQVVTAVCDSFSHGANDVANSVGPLAAIWYIYRFHRIDYQADVPIWILALGGAGIVVGLACYGYNIIRAIGLRLSVITPSRGFCIELSTALVVVVASKFGLPISTTHCQVGATAAIGLMEGSAGINWKLSLQFVLGWLVTILITGLLSAALFAAGAYSPSITQENAISKYEDMIRSVAQELDLLLNRTNTAALSDPATWGNYSEALAADIAQELASMKVWMQEGNSTNTRPVQHMDPDELTEYLSDTVQTYVNNSLPYIGGMAAKGIVLPRPRRRRYGR

SEQ ID NO: 20884 - protein, 366 aa, Haemophilus influenzae Rd
MQYINIANRGVKSLSPYQAGKPIEELERELGISNIVKLASNENPFGFPESAKKAIFEQLDKLTRYPDANGFELKQTIAKKFGVQPNQITLGNGSNDLLELFAHTFATEGDEIMYSQYAFIVYPLVTKAINAIVKEIPAKNWGHDLQGFLTALSDKTKLIYIANPNNPTGNFLTSQEIEDFLAEVPENVIVVLDEAYTEFTRSEERVDSFSLLKKYSNLIISRSLSKAYGLAGLRIGYAVSNPEIADLLNRVRQPFNCNSLALTAAVAVMNDDKFVEKVAENNRIEMRRYEDFCQKNQLDYIPSKGNFITIDFKQPAAPIYDALLREGVIVRPIAGYGMPNHLRISIGLPEENDKFFTALSKVLKFA

SEQ ID NO: 20885 - protein, 234 aa, Zea mays
FTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 20886 - protein, 169 aa, Triticum aestivum
TTFCTPTPWPGAAMLSWATIRAPCQGLKSTDGLTVRRRYISPSLSSVSNGGRIRCMQVWPIEGIKKLETLSYLPPLYTEALLKQVDYLIRCKWVPCLQLSKVDLVFREHNNYGGFYDGRYWTMWKLPMFGCTDTTQVLNEVEEVKKEYPDRYVRGIGLDNLRQVQCVSF

SEQ ID NO: 20887 - protein, 339 aa, Prochlorococcus marinus str. MIT 9313
MHPSMVIPRFSDRPLDVVGIGNAIVDVLVQADDAFLDAHSLSKGNMALVDEAQAEALYSISGPGLETSGGSAANTLVGLAQLGGKAGFIGRVKNDQLGSIFSHDIRSVGARFETPPASDGPSTARCLILVTPDAQRTMCTYLGASVQLDPEDLDLSMVRQAKVLYLEGYLWDSPAAKKAFIAAAQVCRDSGGQVALSLSDGFCVDRHRDSFLELVDSHVDLLFANDSEITSLYKSVSFEAALEEVKGRCKVAALTRSEHGSVVLAGDQRWDIPAYKLGNVVDTTGAGDLYAGGFLHGYTQGTTLETCGQIGSICAGQVITQLGPRSQVSLPELVAKHLN

SEQ ID NO: 20888 - protein, 328 aa, GIBBERELLA ZEAE PH-1
MDNYQRIEKVGEGLSQLITHLIHLLTQLSGTYGVVYKARDLGHSGRIVALKKIRLETEDEGVPSTAIREISVLRELNHANVVSLLNIVHADGHKLYLVMEFLDLDLKKYMDSLPVTDGGRGKPLPTGTATVIRNLGMSDKVVEKFMLDLCQGIKYCHSRRILHRDLKPQNLLIDKEGNLKLADFGLARAFGVPLRSYTHEVVTLWYRAPEVLLGGRQYSTGVDMWSVGTIFAEMCSRKPLFPGDSEIDEIFKIFRTLGTPDEDAWPGVTAYPDFKPSFPKWQRDFSTPLCPNLNEQGLELLDYLLICDPVTRISAKAALNHPYFDDIL

SEQ ID NO: 20889 - protein, 953 aa, Saccharomyces cerevisiae
MNSTNSTNSTTTATSTNTSTQQVVTSLVSNGTIFGVFVIAFLILRIKLKRIYEPKSSFNLINEEKKPEPLPQGVWQWLKPLLKKSDNFVIQQAGLDGYFFLRYLFIIAIYCAVSMSYIFPILLSINASNGNHESGLNQLAYQNVKHRGRYFAHVFCGWIFFWGFLYIIYRELYFYTSMKQAVLASPRYAKKLSSRTVLFQTVPKQYLSEEEFSKLFDGVKRVWIARGSGSIEAMVKARDNMAIQLEGAETKYLKAALKKIKKLNKKSPQLSVSDNIAEYVPDKKRPHHKINKVAKFFFGKKVDTISYIKEELPKLNQKVKALQEDHENSSPFNSVFVEFESQYQAQVAAQITTYHAPLFMTPVYIGIEPSDVVWFNLRMFWWERLGREVSAVSAIVALVILWAFPVAFVGMISNITSLTNEVKWLKFIYKLPKQLLGLLTSLAPTVALAVLMSFLPKFIRGMAITQGAPSKQNVEYFTQQAYFAFQVIQVFLVTTLSSAATSTVTEIVKEPTKAMDLLASNLPKASNFFMSYVILQGLSISSGALLQIVPLILFYVLGAFLDGTVRKKWNRFCGLSSMQWGTAFPVYTNLAVITFSYSIISPLILLFAAVAFFLLYIAYLYNLTYVYQESPDARGIYYPRALFQTIVGIYIGQICLLGLFAVGKGWGPIVLQVIGICVTVLIHLHLSAAFDHLSKVIPVDTMKPLDGVSDTPSFKNIYKGIESTKVKKNTFGANIDMDGIKELPEFPIKKYHKRSESVTEQQVENSIFSENTFEYQFNPANEANADGHAINAENLIEDVPLLADGDTMKIPPAPWWKRFLKPHIYYSYKAVKSRLPEIYGLVDPDERVNDFDISHAYDYPAVSAQCPELWIPRDPFGFSKLLISDVSGVVEMNDENATIDENLKFTLRDVPPPYNDVKDEANGEANGEFDTASKENNPFADPKYKEEESRSAV

SEQ ID NO: 20890 - protein, 90 aa, Zea mays
  unsure (1)..(90): unsure at all Xaa locations
MPNVKSAGGAGASAIPAGGDGEVEAGFAKLQGEDFEYYMQTYSIMLGRNSKKSTVDVDLSSLGXGGMNISRHHARIFYDFQRRRFRARRH

SEQ ID NO: 20891 - protein, 138 aa, Zea mays
MALASATVSSPSRIIRCFSSSTDSRPPLPLPLASRACSWHRLVVGRVGRPRALLGGFSDAGASESDDEEEHGLRGGKRDGEVDDALELSAPAVGPERWDVLGLGQAMVDYSGMVDDEFLERLSIEKGARNGINHEERG

SEQ ID NO: 20892 - protein, 316 aa, Escherichia coli
TDKLTSLRQYTTVVADTGDIAAMKLYQPQDATTAPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 20893 - protein, 341 aa, Triticum aestivum
MRMSLLRSASQHLRRRRDYSSAAASPERKVAILGAAGGIGQPLALLMKLNPLVSSLSLYDIAATPGVAADVSHINTRALVKGFVGDDQLGEALEGADLVIIPAGVPRKPGMTRDDLFKINAGIVKGLCTAIARHCPNALVNMISNPVNSTVPIAAEVFKKAGTYDEKKLFGVTTLDVVRAKTFYAGKANVPVTGVNVPVVGGHAGITILPLFSQATPASNALSHEDLVALTKRTQDGGTEVVEAKAGKGSATLSMAYAGAVFGDACLKGLNGVPDIVECSFVQSTVTELPFFASTAGLGKSGVEEVMGLGELSALEKEGLESLKGELLSSIEKGVKFAQES

SEQ ID NO: 20894 - protein, 531 aa, Emericella nidulans
MAFKKSYNVYFLCGFMTLGGGLFGFDISSMSGVLGTAAYNNYFQVGGGNYKQGGITCAMPFGSLVGALASSFLADKYSRVTAIQFSSTLWIIGSVFQCAANGIPLLVVGRVIAGLCVGIASAMVPVYIAEVSPKHIRGRMISLQQWAITWGILIQYFIQYGASNVDGGPDNETQSTAAFRIPWGIQIVPGVIYFVGLFLYPKSPRWLASKDRWDECMHVLARLHGNGDMNHPLVLAQYKEIQDALALEREQASTSYQELIKPRIAKRVFLGMSLQMWSQLSGMNVMMYYIVYIMQSTGAGSPLLTASIQYILNTALTLPAILWLDRFGRRPAILIGFTMQAIFLYIEGGLQAGYGRSTRPSDDLNAISWTVADHPGVGKAIIAMSYLFVCSFATTIGPTSWTYPAEIYPAKVRAKAVSLATASNWTWNCLLALFVPPLLWNINWKMYMIFAAFNTVAALHMFLTAPETKGYTLEEMDEVFESGIAPWKKRKISSRLEQIEREIAEGNLKVTDRTGPVDPVQENVGEPEKAV

SEQ ID NO: 20895 - protein, 362 aa, Populus tremula x Populus tremuloides
MSRSPEEEHQHKAFGWTAKDSSGVLSPFHFSRRDNGVEDVTIKILYCGVCHSDLHAAKNEWGFSRYPLVPGHEIVGIVTKIGSNVKKFKVDDQVGVGVMVNSCKSCEYCDQDSENYCPKMIFTYNAQNYDGTKTYGGYSDTIVVDQHFVLHIPDSMPADGAAPLLCAGITVYSPMKYYGMTEPGKHLGIVGLGGLGHVAVKIGKAFGLKVTVISSSSRKEREALDRLGADSFLVSSDPEKMKAAFGTMDYIIDTVSAVHALAPLLSLLKTNGKLVTLGLPEKPLELPIFPLVLGRKLVGGSDIGGMKETQEMLDFCAKHNIIADVEVIRMDQINTAMDRLAKSDVRYRFVIDVANSLSQSQL

SEQ ID NO: 20896 - protein, 374 aa, Mycoplasma hyopneumoniae
MDKFRYVKPGQIMAKDEEMIRFLDIDGNLLSSTVFGPIDETNDIRLSKQEIKKAYEFMVLSRQQDTYMTQLQRQGRMLTFAPNFGEEALQVASGMALTKDDWFVPAFRSNATMLYLGVPMILQMQYWNGSEKGNVIPENVNVLPINIPIGTQFSHAAGIAYAAKLTGKKIVSMSFIGNGGTAEGEFYEALNIASIWKWPVVFCVNNNQWAISTPNKYENGASTIAAKAMAAGIPGIRVDGNDLLASYEVIKEAVDYARSGNGPVLVEFVTWRQGVHTSSDNPRIYRTVEEEKEHEKWEPMHRIEKYMFDRGILDSAEKQKIWDEALAIVKETYEKSLVGLESTIDEIFDHTYKVLPPELEEQKQEALEFFKGVK

SEQ ID NO: 20897 - protein, 415 aa, Polysiphonia fibrata
EASAAVAGESSTATWTVVWTDLLTACDLYRAKAYKVDAVPNTTDQYFAYIAYDIDLFEEGSIANLTASIIGNVFGFKAVKALRLEDMRLPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLDINLPQGIFFKQDWASLRKVTPVASGGIHCGQMHQLLDYLGNDVVLQFGGGTIGHPDGIQAGATANRVALESMVIARNEGRDYVGEGPQILLDAAKTCGPLQTALDLWKDITF

SEQ ID NO: 20898 - protein, 182 aa, Pseudomonas stutzeri
MIFDEFSIKTLIRPVQDFPRPGVVFRDITPLFQSPKALRMVADSLIQRYVEADFTHIGALDARGFLVGSILAYELNKPLVLFRKQGKLPADVLSQAYSTEYGEAHLEIHADSLCEGDSVLLFDDLIATGGTLLAAAQLVRRMRANIHEAAAIIDLPELGGSQKLQDIGIPTFTLTAFALSDR

SEQ ID NO: 20899 - protein, 375 aa, Prionitis lanceolata
VTTADGKFSAMVPSGASTGIYEALELRDGDKSAYLGKGVDKAVANVKDKIAPAISGMDAADQAAVDKKMIELDGTEGGFKKNLGANAILGVSMAVARAGAAAKRVPLYKHLNDLAGSPKMLLPVPSLNVINGGSHAGNKLAMQEFMILPVGATSFREAMKMGAETYQYLKKVIKKKYGLDATSVGDEGGFAPNIQDNTEGLRLLEEAIEMAGYTGKIKVGMDVAASEFWKDDTKMYDLDFKNPDNDGSQCLSGEKLGELYKEFVAKFPMISIEDPFDQDDWESYAKLTEAVGESVQIVGDDLLVTNPDRIRTGIEKKACNALLLKVNQIGSVTEATQASQISRDAGWGVMVSHRSGETEDTFIADLCVGLGTAQI

SEQ ID NO: 20900 - protein, 350 aa, Coffea canephora
MAEEEACLFAMSLASASVLPMVLKSAIELDLLELIAKAGPGAYVSPSELAAQLPTHNPEAPIMLDRILRLLATYSVLDCKLNNLADGGVERLYGLAPVCKFLTKNADGVSMAPLLLMNQDKVLMESWYHLKDAVLDGGIPFNKAYGMTAFEYHGTDPRFNKVFNQGMSNHSTITMKKILEVYRGFEGLKTVVDVGGGTGATLNMIISKYPTIKGINFELPHVVEDAPSHPGVEHVGGDMFVSVPKGDAIFMKWICHDWSDDHCRKLLRNCYQALPDNGKVILAECVLPEAPDTSLATQNVVHVDVVMLAHNPGGKERTEKEFEALAKGAGFKEFRKVCSAVNTWIMELCK

SEQ ID NO: 20901 - protein, 506 aa, Vibrio vulnificus CMCP6
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSDRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLASGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 20902 - protein, 380 aa, Cucurbita maxima
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 20903 - protein, 421 aa, Oryza sativa
  unsure (1)..(421): unsure at all Xaa locations
MENMRSENFNQGVSMEGVKHAPEMANTNRRALRDIKNIIGAPHQHMAVSKRGLLDKPAAKNQSGHRPMTRKFAATLANQPSIAPLAPIGSERQKRTADSAFHGPADMECTKITSDDLPLPMMSEMDEVMGSELKEIEMEDIEEAAPDIDSCDANNSLAVVEYVDEIYSFYRRSEGLSCVSPNYMLSQNDINEKMRGILIDWLIEVHYKLELLDETLFLTVNIIDRFLARENVVRKKLQLVGVTAMLLACKYEEVSVPVVEDLILICDRAYTRTDILEMERMIVNTLQFDMSVPTPYCFMRRFLGAALPVGRLELMSFFIIELSLVGYXEMLKFQPSMLAAAAIYTAQCTINGFKSWDKCCELXHTKYSEEQLMECSKMMVELHQKAGHGKLTGVHRKYSTFRYGCPAKSEPAVFLLKSVAL

SEQ ID NO: 20904 - protein, 446 aa, Ahnfeltiopsis svensonii
  unsure (1)..(446): unsure at all Xaa locations
LFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIVCERERMDKFGRPFLGATVKPKLGLSGKNYGRVVYEGLKGGLDFLKDDENINSQPFMRWKERYLYSMEXVNRAIAASGETKGHYLNVTAATMEDMYERAEFAKQIGSIIIMIDLVIGYTAIQTMAIWARKNDMILHLHRAGNSTYSRQKIHGMNFRVICKWMRMAGVDHIHAGTVVGKLEGDPLMIRGLXXXXXLPYLEVNLPQGIFFEQDWASLRKVTPVASGGIHCGQMHQLLDYLGIDVVLQFGGGTIGHPDGIQAGATANRVALESMVMARNEGRDYVAEGPQILQDAAKTCGPLQTALDLWKDITFXYTSTDTADFVETPTANV

SEQ ID NO: 20905 - protein, 442 aa, Glycine max
MRGVRGRVHYNLKKSVLVTPSDNWLRCDDSLVMQFLEIKNGYNYFRYVHSLSYSQSQRAFEAAKAINDINGIASILQHRPYHIDSLLTMAEYFAVLGEQQMSADAIARCLYALECAWHPMFNPLQGNCQLKFKHDTNKPIFTALFTHMKNLDRRGCHRSALEVCKLLLSLDSDDPMGAIFCIDYFALRAEEYAWLEKFSEEYKSDNSMWLFPNFSYSLAISRFYLEGEACKDDCMDSEKASSSDLMKQALMLHPSVIKKLVAKVPLKDRTWTDILKHAFFRSDQTGIPSQDHLINIYVERNYLLWRIPDLQKVLSGAAKLVIETLESNKSEVKDWACVRKEAFSSEKNEYGHLMVSDFSDSLSSIPRENLQQFMGVPRMMEGMQDENQFANLPGNGHAPRRVANRNALAVLFESMLPWVTYEDGVDGGPDDDQHDDHRQDNQ

SEQ ID NO: 20906 - protein, 335 aa, Zea mays
  unsure (1)..(335): unsure at all Xaa locations
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 20907 - protein, 278 aa, Desulfitobacterium hafniense
VHIEAVHALAHGHSSMRFTPRARSRRKAAAVRRGEHERKWEQRTQCARRGAALLRCRARLRRALHVRSIEDAHLRHWRPARQGEPRMHRPDPTPSARRSRGRRAAATLLAVAALALSAFAHADEFVLQSADLREGEQVPALHLFPACAGGNVSPTLEWKNPPEGTRSFAITVFDPDAPTGNGWWHWALVNLPADTAALPRGAKPPAGAMALRNDFGVAGYSGPCPPPGKTHRYEFTVWALKSDKLKLDAKAQAMLGGAMARADALGHATITVKYSRPK

SEQ ID NO: 20908 - protein, 163 aa, Zea mays
MDAVMFGLETPLMAALQHLLDVPDGDAGAGGDSDNKTGGGATRTYVRDARAMAATPADVKELPGAYAFVVDMPGLGTGDIRVQVEDERVLVVSGERRREEREDAKYLRMERRMGKFMRKFVLPDNADVDKVAAVCRDGVLTVTVEKLPPPEPKKPKTIEVKVA

SEQ ID NO: 20909 - protein, 935 aa, Neurospora crassa
MTRRDAEVKDRCDTGRESPSTDGTGKSIFHVKPPALAALRFLHLLHLALTCFASICCRFPTFRYNTFPKAFKAAYSSQQQAVTLSKPNRVYSGVSNGWTTRVCKRSISISRRMGKNRLPVSPWTVLMSGATAPRLQNVLSRPVLSSKRDAGRTSSHHLLKSLLLASRFAASTLVATTSSAGASRSTGTSSPDPGPTINKSQTNRNPSTYTSPPNSLSRTFSASNLLAWYRTLPSPYFNLSGHLDDLSSLIRPFLAFLDPSSLSSPYSMASTSYAFSTSSGSDFSTPRSSSPHSSASVASARSSHSSTFSAGKRLSMSSVRRTSASNPMSSVDLSTIEEALKMANLDTLKGYCQKTYGEVHQETTTEYISQEEARGYQVLNQPHWNKVADFRISPKGTSFTPEERVAKNLTGLIPHVMEDSEKQVERALKMIRTRQTDIDRYLYLSTIKSQNVDLFYRLLMDHAKEMMPLVYTPTIGDVCLQYSTLYTRPEALYISIKQRKSIRTILRNWPYPQPEICVVTDGSRILGLGDLGVNGVGIPIGKLALYTAAAGIHPDKTLPIVLDCGTANETNLKDPLYLGLRQKRIPVAEQQEFMDEFMEAAAEVFPDMVVQFEDFESEKAFNYLDRYRDQYKCFNDDIQGTGAVVLAGYIGAVNLSNVPIEEQRLVFMGAGSAGVGVAKQLVEYYTKRGLSEQQAKDKFWLVDTKGLVTKDRGDKLAEHKKYFARTDNNGHQFRTLEEVIEYVKPSALVGLTATHGVFTESVVRALKASVDAGGLGRRPILFPLSNPLTKAECTFKEAIDWTDGTVLFASGSPFSSYTTNGVTYHPNQGNNVYVFPGIGLGAILAKATRVTDDMIYTSAAALANSLNADEVKQGLIYPRIDRVREASVIVAREVMKSARREGVSTLPEEQWLEWEEWGDVDLERYIKQHIYDPKF

SEQ ID NO: 20910 - protein, 394 aa, Solanum tuberosum
MDGSAQQTDTVMSDAAAGQQPATPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEGALAHPYLTSLHDISDEPVCMTPFSFDFEQHALTEEQMKELIYREGLAFNPEYQHM

SEQ ID NO: 20911 - protein, 461 aa, Zea mays
MPPSKARRKRSLRDITATVATGTVANSKPGSSSTNEGKQQDKKKEGPQEPDIPPLPPVVVNIVPRQGLGCEVVEGLLVPSRKREYKPNSKYTVGNHPIYAIGFNFIDMRYYDVFAIASCNSVIIYRCLENGGFGLLQNYVDEDKDESFYTLSWTIDQVDSSPLLVAAGSNRIIRVINCATEKLDKSLVGHGGSIHEIRTHASKPSLIISASKDESIRLWNVHTGICILVFAGAGGHRHDVLSVDFHPTEVGIFASCGMDNTVKIWSMKEFWIYVEKSYSWTGHPSKFPTRNIQFPVLTAAVHSDYVDCTRWLGDFILSKSVKNAVLLWEPKPDKRRPGEGSVDVLQKYPVPKCSLWFMKFSCDFYSNQMAIGNNKGEIYVWEVQSSPPVLIDRLCNQECKSPIRQTAVSFDGSTILGAADDGAIWRWDEVDPAASSSKPDQAAAPAAGVGAGAGADADADA

SEQ ID NO: 20912 - protein, 472 aa, Arabidopsis thaliana
AIWFARSKTLVSSLRHNLNLSTILIKRDYSHRPIFYTTSQLSSTAYLSPFGSLRHESTAVETQADHLVQQIDEVDAQELDFPGGKVGYTSEMKFIPESSSRRIPCYRVLDEDGRIIPDSDFIPVSEKLAVRMYEQMATLQVMDHIFYEAQRQGRISFYLTSVGEEAINIASAAALSPDDVVLPQYREPGVLLWRGFTLEEFANQCFGNKADYGKGRQMPIHYGSNRLNYFTISSPIATQLPQAAGVGYSLKMDKKNACTVTFIGDGGTSEGDFHAGLNFAAVMEAPVVFICRNNGWAISTHISEQFRSDGIVVKGQAYGIPKHPVWDGTDALAVYSAVRSAREMAVTEQRPVLIEMMTYRVGHHSTSDDSTKYRAADEIQYWKMSRNPVNRFRKWVEDNGWWSEEDESKLRSNARKQLLQAIQAAEKWEKQPLTELFNDVYDVKPKNLEEQELGLKELVKKQPQDYPPGFHV

SEQ ID NO: 20913 - protein, 69 aa, Populus alba
FKADLPGIKKDEVKVEIEDDRVLQISGERSVEKEDRNDTWHRVERSSGKFLRRFKLPENARTDQVKAGM

SEQ ID NO: 20914 - protein, 471 aa, Dasya hutchinsiae
  unsure (1)..(471): unsure at all Xaa locations
SGVIPYAKMGYWDPNYVTKETDVLALFRVSPQPGVDPVEASAAVAGESSTATWTVVWTDLLTACDLYXAKAYKVEAVPNSTDQFFAYIAYDIDLFEEGSIANLTASIIGNVFGFKAVKALRLEDMRIPVAYXXTFQGPATGIVVERERMDKFGRPFLGATVKPKLGLSGKNYGRVVYEGLKGGLDFLKDDENINSQPFMRWKERFLYSMEAVNRSIAATGEXXGHYXNVTAATXEDMXXRAEFXKQLGTVIIMIDLVXGYTAIQTMAIWARXXXMILHLHRAGNSTYSRXXIHXXXXXXXXXXXRXAGVXXXXAGTVVGKLEGDPLMIKGFYDTLLLPYLEINLPLGLFFEQDWASLRKVTPVASGGIHCGQMHQLLDYLGNDVVLQFGGGTIGHPDGIQAGATANRVALEAMVIARNEGRCYVAEGPQXLFDAAKTCGPLQTALDLWKDITFNYTSTDTADFVETPTANV

SEQ ID NO: 20915 - protein, 360 aa, Physcomitrella patens
MSPSVDCLASLYCAEDVSGTAWNESEMCGAADRVFESQPAVFMDFPVEDDEAIATLLMKEAQFMPEADYLERYQSRKLSLEARLAAIEWILKVHSFYNYSPLTVALAVNYMDRFLSRYYFPEGKEWMLQLLSVACISLAAKMEESDVPILLDFQVEQEEHIFEAHTIQRMELLVLSTLEWRMSGVTPFSYVDYFFHKLGVSDLLLRALLSRVSEIILKSIRVTTSLQYLPSVVAAASIICALEEVTTIRTGDLLRTFNELLVNVESVKDCYIDMRQSEIGPYCVRMGLKRKILHASEPQSPVGVLEAADVSSPSGTVLGFSSRESSPDVTDSPPSTNSQRKRRKLCLHNESCLHVESASL

SEQ ID NO: 20916 - protein, 201 aa, Haemophilus somnus 2336
MARIIFLDNFDSFTYNLVDQFRSLGHQVQVFCNNFDLKLLTQIILAEKETVLALSPGPGTPAQAGILLPLIQTLKGKVAMIGICLGHQALIEAFGGDVVPSGEISHGKVSNIYHDNQMMFQGLDNPMPVARYHSLMGRKISEEFIINAEYKGIIMAIRHKTLPICSFQFHPESILTKQGSQLLEQSIQWLLAQSREQYNYL

SEQ ID NO: 20917 - protein, 355 aa, Lycopersicon esculentum
MENNNYNNHVSGENSGGQRGHFFYGGNQVLGGAAPIYGRGGDCYDPMIVKTEGGGSTSHHNHTFHYPSIIRNHHHDSTETSGGGAGAGEVIEALKAKIIAHPQCSNLLDAYMDCQKVGAPPEVAARLSAVRQEFEARQRRSLTDRDVSKDPELDQFMEAYYDMLVKYREELTRPLQEAMEFMQKIEAQLNMLGNAPVRIFNSEDKCEGVGSSEEDQDNSGGETELPEIDPRAEDRELKNHLLRKYSGYLSSLKQELSKKKKKGKLPKDARQKLITWWELHYKWPYPSESEKVALAESTGLDQKQINNWFINQRKRHWKPSEDMQFMVMDGLHPQSAAALYMEGHYMGEGPFRLGQ

SEQ ID NO: 20918 - protein, 210 aa, Lilium regale
MGRGKIEIKRIENSTNRQVTFSKRRNGIIKKAREISVLCEAQVSVVIFSSSGKMSEYCSPSTSLPKILERYQVNCGKKIWDPKHEHLSAEIDRIKKENDNMQIQLRHLKGEDLNSLQPKELIPIEEALENGIRGVREKQNDFLRMLKKNERILEEDNKRLTYILHHQQLAMDENMRNLEFAYHHKDGDFSSQMPMAFRVQPIQPNLHEDK

SEQ ID NO: 20919 - protein, 339 aa, Burkholderia fungorum
MRTMKAVQVAQAGGPLELVERDVPEPGAGQVLIKIQACGICHSDVLTKEGQWPGLEYPRVPGHEIAGVIDTVGAGVEEWQAGQRVGVGWHGGHCGHCEHCRRGDFVLCQRALVPGISYDGGYAEFMLAPVEALARIPDDLADVDAAPLLCAGITTFNALRNSGARAGDVVAILGIGGLGHLGVQFARKMGFVTVAIARGQDKASLAKQLGAHHYIDSTAANVAQALQALGGARVILATVTSGKAMSAVVGGLGLNGKLIMVGLSDEPVEVPVAQFIMGRNSVQGWPSGTSADSQDTLAFSALSGIKPMIEEFPLTKAAEAYERMMSGAARFRVVLNTGR

SEQ ID NO: 20920 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 20921 - protein, 150 aa, Gibberella zeae
WRVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGRSEGNTDEVTRAQNLQSAK

SEQ ID NO: 20922 - protein, 136 aa, Lactobacillus delbrueckii subsp. lactis
  unsure (1)..(136): unsure at all Xaa locations
AGGTXVXINAGITALVLSIFLGPRYQKQTRPYSLPWVLLGTAILWLGWYGFNAGSAFGMNQTALTACLTSTVAAAASMMTWLLLEETFSGKASLDGICTGTLCGLVGITPGAGYETCAGALFTGILCSLASYFFIS

SEQ ID NO: 20923 - protein, 474 aa, Streptococcus pneumoniae R6
MTRYQNLVNGKWKSSEQEITIYSPINQEELGTVPAMTQTEADEAMQAARAALPAWRALSAIERAAYLHKTAAILERDKEKIGTILAKEVAKGIKAAIGEVVRTADLIRYAAEEGLRITGQAMEGGGFEAASKNKLAVVRREPVGIVLAIAPFNYPVNLSASKIAPALIAGNVVMLKPPTQGSISGLLLAKAFEEAGIPAGVFNTITGRGSEIGDYIIEHKEVNFINFTGSTPIGERIGRLAGMRPIMLELGGKDAALVLEDADLEHAAKQIVAGAFSYSGQRCTAIKRVIVLESVADKLATLLQEEVSKLTVGDPFDNADITPVIDNASADFIWGLIEDAQEKEAQALTPIKREGNLLWPVLFDQVTKDMKVAWEEPFGPVLPIIRVASVEEAIAFANESEFGLQSSVFTNDFKKAFEIAEKLEVGTVHINNKTQRGPDNFPFLGVKGSGAGVQGIKYSIEAMTNVKSIVFDVK

SEQ ID NO: 20924 - protein, 436 aa, Magnetospirillum magneticum
MELHHPELTYAAIVALAAVLCGGMMTRLKQPAVVGYILAGVVLGPSGFGLVSNRDAVATLAEFGVLMLLFVIGMKLDIIRFLEVWKTAIFTTVLQIAGSVGTALLLRHGLGWSLGLAVVLGCAVAVSSTAVVIKVLESSDELDTPVGRTTLGILIAQDMAVVPMVLVLESFGTKALLPADMARVVLSVVFPGLLFWWLSKRRIDLPITARLSRDSDLATLSTLAWCFGTAAISGVLDLSPAYGAFLGGVVLGNSAQRDMLLKRAQPIGSVLLMVFFLSIGLLLDFKFIWKNLGTVLTLLAMVTLFKTALNVTALRLAGQDWPSAFLAGVALAQIGEFSFLLAETDKAVKLISAQETKLVVAVTVLSLGLSPFWLFTMRRMHRVAAVHVHSFRDLVTRLYGDEARAFARNARRARVLVRRGSWRDDPNAGPGSGIST

SEQ ID NO: 20925 - protein, 485 aa, Oryza sativa (japonica cultivar-group)
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISRQWNYAIQYCWSAVNLMAYINRTTLNHRSRELEQQLECVVCYGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 20926 - protein, 365 aa, Pseudomonas aeruginosa UCBPP-PA14
MTLTALASSSILLSPRAFAGSGATSAAGKPQETFLDFNESPYGPSAKARAAMQQAAALCGRYDYDAQDALVGLFAKQNGIPAESVHAYCGSRQPLQYAVAAFTGKERSLVMADPSYDSVLGAAQAQGAKVAAVPLDAEAAHDIERMLAAAQRDAGLIYICNPNNPTGTLTPHERIVRAIERKPERSVVLVDEAYIHFSDAPSVVGLAVQRQDVLVLRTFSKLYGMAGARLGLAIGHPQLLARLERFGGHNVVPSPTAHAGLESLRDDDLVPRRKQQNAEVRERTIAWLRQQGFRCTASQSNCFMVDMRRPAELVIAELEKQRVHVGRPWASWPNWVRVTVGSEEEMQAFRSAFASVSRRHQVAMR

SEQ ID NO: 20927 - protein, 845 aa, Kluyveromyces marxianus
MSKFDVEQLLSELNQDEKISLLSAVDFWHTKKIERLGIPAVRVSDGPNGIRGTKFFDGVPSGCFPNGTGLASTFDRDLLETAGKLMAKESIAKNAAVILGPTTNMQRGPLGGRGFESFSEDPYLAGMATSSVVKGMQGEGIAATVKHFVCNDLEDQRFSSNSIVSERALREIYLEPFRLAVKHANPVCIMTAYNKVNGDHCSQSKKLLIDILRDEWKWDGMLMSDWFGTYTTAAAIKNGLDIEFPGPTRWRTRALVSHSLNSREQITTEDVDDRVRQVLKMIKFVVDNLEKTGIVENGPESTSNNTKETSDLLREIAADSIVLLKNKNNYLTSKERRQYHVIGPNAKAKTSSGGGSASMNSYYVVSPYEGIVNKLGKEVDYTVGAYSHKSIGGLAESSLIDAAKPADAENAGLIAKFYSNPVEERSEDEEPFHVTKVNRSNVHLFDFKHEKVDPKNPYFFVTLTGQYVPQEDGDYIFSLQVYGSGLFYLNDELIIDQKHNQERGSFCFGAGTKERTKKLTLKKGQVYNVRVEYGSGPTSGLVGEFGAGGFQAGVIKAIDDDEEIRNAAELAAKHDKAVLIIGLNGEWETEGYDRENMDLPKRTNELVRAVLKANPNTVIVNQSGTPVEFPWLEEANALVQAWYGGNELGNAIADVLYGDVVPNGKLSLSWPFKLQDNPAFLNFKTEFGRVVYGEDIFVGYRYYEKLQRKVAFPFGYGLSYTTFELDISDFKVTDDKIDISVDVKNTGDKFAGSEVVQVYFSALNSKVSRPVKELKGFEKVHLEPGEKKTVNIELELKDAISYFNEELGKWHVEAGEYLVSVGTSSDDILSVKEFKVEKDLYWKGL

SEQ ID NO: 20928 - protein, 353 aa, Ustilago maydis
MGCGASKVDKEGQARNDAIDAQLKKDRLAQKNEIKMLLLGAGESGKSTILKQMKLINHGSYSAEERESYKEIIFSNTVQSMRVLLDAMERLDIPLADATNAPRAEIILGLSPSIESSVLPRQVADAIHALWGDAGVQACFGRSREYQLNDSAKYYFDSIQRMAEPSYLPTDQDVLRSRVKTTGITETHFKIGELNYKLFDVGGQRSERKKWIHCFENVTAIIFLVAISEYDQLLYEDENVNRMQEALTLFDSICNSRWFVKTSIILFLNKIDLFKQKLPISPMADYFSDYTGGADYNSASEYIVNRFVSLNQSDAKTIYTHFTCATDTSQIKFVMSAVNDIIIQVNLRDCGLL

SEQ ID NO: 20929 - protein, 251 aa, Triticum aestivum
MSTAVARPYVGGFPGSGRAKGDELLGKKMSDGFFIEEEEEEEEEEAEEVLTESSSIGAPSPSSSSIGEDSSSEVGGEGEDEEVESKLKEEPGLGCLDALEDSLPIKNGLSSFYAGKSKSFTSLAEAAARDAVKELAKPENPFNKRRRILATWSRRASCSSLATATYLPPLLAPDHALPEGEEGEEDDDSDSGSDEQHRGKNGWEAPALPPPRLSVNTQMGAAAARKGGSFRSPRSYSLSDLRNGGDARYNQ

SEQ ID NO: 20930 - protein, 180 aa, Triticum aestivum
MSTDIVVLVAVIILIGVFSMQHFGTDKVGWLFAPIVLMWFILIGSVGALNIHKHGSSVLKAYNPVYIYRYFRRNGNSSNTWTVLGGIMLSITGTEALFADLCHFPVLAIQIAFTFIVFPCLLLAYTGQAAYIISNKQHVNDAFYRSIPDAIYWPAFVIATAAAIIASQATISATYSIIKQ

SEQ ID NO: 20931 - protein, 440 aa, Ahnfeltiopsis vermicularis
  unsure (1)..(440): unsure at all Xaa locations
QPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIICERERMDRFGRPFLGATVKPKLGLSGKNYGRVVYEGLRGGLDFFKDDENINSQPFMRWKERYLYSMEGVNRSIAASGEIKGHYLNVTAATMEEMYERAEFAKELGXXXXMIDLVIGYTAIQTMAVWARKNDMILHLHRAGNSTYSRQKIHGMNFRVICKWMRMAGVDHIHAGTVVGKLEGDPLMIEGFYNTLLLPYLEVNLPQGIFFEQDWASLRKVTPVASGGIHCGQMHQLLDYLGIDVVLQFGGGTIGHPDGXXXXXXXXRVALESMVIARNEGRDYVAEGPQILQDAAKTCGPLQTALDLWKDITFNYTSTDTADFVETPTANV

SEQ ID NO: 20932 - protein, 460 aa, Pinguiococcus pyrenoidosus
  unsure (1)..(460): unsure at all Xaa locations
ESGVIPYAKMGYWDADYAVKDTDVLAMFRITPQPGVDPIEAAAAVAGESSTATWTVVWTDLLTACDVYRAKAFRVEPVPGASDQFFSYIAYECDLFEEGVFGFKAVKALRLEDMRIPYAYLKTFQGPATGLIVERERMDKYGRPFLGATVKPKLGLSGKNYGRVVYEGLRGGLDFLKDDENINSQPFMRWRERFLYVMXGVNRAAAASGEVKGSYLNTTAATMEDMYERAEYAKTVGTIIIMIDLVIGYSAIQSMAIWSRKNDMILHLHRAGNSTYARQKNHGINFRVICKWMRMAGVDHIHAGTVVGKLEGDPLMVKGFYNTLLETELTINLPQGLFFDMDWAALRKCVPVASGGIHCGQMHQLIHYLGEDCVLQFGGGTIGHPDGIQAGATANRAALEAMMLARNEGRDYLAEGPEILNAIARKCRPLQVALDLWKDISFNYTSTDTADFVETPTQNV

SEQ ID NO: 20933 - protein, 171 aa, Larix laricina
APSKTGNSNVVSAFTGLKSMAQFPSSKTMSNAGAEWERKTTSNGARVRCMQVWPPYANKKWETLSYLPRLTPEQLVKEVEYLLKNKWVPCLEFEEDGEIKRVYGNSPGYYDGRYWVMWKLPMFGCTEASQVLNEVNECAKAYPNAYIRVIGFDNVRQVQCISFIVHKPEYN

SEQ ID NO: 20934 - protein, 89 aa, Oryza longistaminata
DAKARYVKFHWKPTCGVSCLMDDEATLVGGKNHSHATQDLYDSIAAGNFPEWKLFVQVIDPEEEERFDFDPLDDTKTWPEEEVPLRPVG

SEQ ID NO: 20935 - protein, 757 aa, Oryza sativa; identical to SEQ ID NO: 1506

SEQ ID NO: 20936 - protein, 408 aa, Eremothecium gossypii
MLSSVRNPALAKVKTSLLRTLSTTGAVRAEAVESAGADEEVEIRLPETSFEGYMLDVPELTYKVTKGNLLQMYKDMIVVRRMEMACDALYKAKKIRGFCHLSVGQEAIAVGIENAITKRDTVITSYRCHGFTYMRGASVRAVLAELMGRRTGVSYGKGGSMHMYTDGFFGGNGIVGAQVPLGAGLAFAHQYKNEDVCAFALYGDGASNQGQVFEAFNMAKLWNLPAVFACENNKYGMGTAASRSSAMTEYFKRGQYIPGLKVNGMDILAVYQASKFAKHWCVSGKGPIVLEYETYRYGGHSMSDPGTTYRTRDEIQHMRSKNDPIAGLKMQLLDLGIASEEEIKAYDKAARKYVDEQVELADAAPAPEAKMSILFEDVYVPGTETPTLRGRINDDTWDFAKKGFAFRD

SEQ ID NO: 20937 - protein, 430 aa, Clostridium thermocellum ATCC 27405
MGNLMHKKEIIALLLAGGQGSRLGVLTKNIAKPAVLYGGKYRIIDFSLSNCVNSDIDTVGVLTQYQPLELNAHIGIGKPWDMDRINGGVTILSPYLKAEIGEWYKGTANAVFQNIHYVDKYSPKYVIILSGDHVYKMNYSQMLDFHKENNADATISVINVPWEEASRYGIMNTYENGKIYEFEEKPQNPKSNLASMGVYIFNWEVLKEYLIRDDQNEESAHDFGKNIIPMMLKEGRSMWAYKFNGYWRDVGTIQAYWESNMDLISRVPEFNLFDPAWKIYTPNPVKPAHYIGPTGSVKKSIVAEGCMIYGSVRNSVLFPGVYVSEGAEIVDSIVMSDSVIGENTQIYKCIIGEEVKVGKNVRMGIGENIPNELKPHLYDSGITVVGEKAVVPDGCQIGKNVVIDPYITAEEFPSLNIESAKSVLKGGETE

SEQ ID NO: 20938 - protein, 344 aa, Zea mays
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGPFVDYYLNGRSLLNYPFSGGATFFILLSCSLAVFCNMSQYLCIGRFSATSFQVLGHMKTVCVLILGWILFDSALTMKNILGMLLAVMGMVVYSWAVEAEKKAAAPIPRNKGGMLDGEDVPLKARVSGVPAVDLEDGDVKG

SEQ ID NO: 20939 - protein, 1419 aa, GIBBERELLA ZEAE PH-1
MASPSRIPSDQPPRSSSPSSFRPRSISASVPRADLTARLASPIPSQFGTTPPVGGTPRPDAASRSDNLDDLSQLPGTGTSMQGPGQSPPRHGTPAARVSTPPIRSQSPLLGARNSGTPTNYGSFNSRSQNALGTSAPYEDPEIVKRHLVQPSDENPTSEESSIQGNTKGKQPADIGGAGLNEDEFSSLRLQGGDVTRGIYKWTEQAEARAKYNRSKSFDLGRPEPEAEVLDINSIKVPGGFRRNHLRRSVQSPGPHGHLEDGHNSPAPGQQRLFTSSFLEFLSIYGHFAGEELEEDDENLGPNEYFSSGEDSDEYNSDDEREPMEDSALLTPSRRRRKRKVRGGSGNNSPMNAALLLLKSFVGTGVLFLPRAYLNGGMLFSNLILFGVAALSYYCFVLLVKTQLKIGGSFGDLGGALYGKKMRTLILSSIVISQIGFVAAYTVFTAANLQAFVRAVSDCKSSISIQWLILIQMIIFLPFALLRDIGKLAFTALVADAFILIGLAYLLYYDILTLNQNGIADIIMFNKKDWTLFIGTAIFTFEGIGLIIPVQESMRHPEKFPRVLLIVMIIITVLFIGMGAISYAAYGSHTETVVLLNLPQDNKMVNGVQFLYSVAILLSTPLQIFPAIRIAETELFTRSGKYNPWVKWQKNVFRFFVVMLCASIAWLGADHLDKFVALVGNFACIPLVFIYPPMLHYKAIARTKFWRVADIALCIFGFVAMAYATTLTAMSWATADPKHPGYCDQKVHGVEYGPRGPRDCTQHLEWQTRPPPPPPFNTVPTCPEPTCGCAEPPKMPDDLPLDREGPLKGAIAGYAEHVLPFHNVSVLNSSFPSSTSPRPQLQTTSAYLLPSFKYIPFLPRVSFDSVEALVKGFLLPEKLHRMHDGLSPIHRDRLTRKEGYQGLLPGVQDVRDILVLICGHTGRDARCGIMAPILATEFEEKLEKEGFDVQHGPVQINLNEMQRIQGEAGEEKTSARIGMISHIGGHKFAGNVIIYLPPDLKMGSEPHPLAGHGICQLSASKARTLKTSPNPSITPTQRYASHKPNFPAPLQARIFPSLILVGIVLVSGGCYLLTPPSRPNTLNDITFVPYAITAREAISPTSFVITAVPRTPNPSLPYLNPSDSQWKNPLWSVEFKQPEVQISRHYTPLPPLSSEDPTDGTLRFYIRAVGDGEMSNYLGRRRVGDDVFLRGPHVGFELAERLGEHSRLVFLAGGTGVVPGIQAAKAVLEANEKSSVDLLWAVRKREEVQNSAFPSSSSWKFWQGKRPTALGLEVESPSPVTKRLQDLKKTYGDRLRIQVVVDEEGTRFQDKDINSTITASPGTVASFNAGCRFHDQAMHVHASEFALSEGPGCVCEPPAGTTPGKNLFIVSGPDGFIEHYAGPKIWLGGHQTQGPIAGVAGHLQRQNPALARDWLVLKM

SEQ ID NO: 20940 - protein, 348 aa, Saccharomyces bayanus
MSIPKTQKGVIFYESNGKLEHKDIPVPTPKPNELLINVKYSGVCHTDLHAWHGDWPLATKLPLVGGHEGAGVVVAMGENVRGWKVGDLAGIKWLNSSCMACEYCELGNESNCPHADLSGYTHDGSFQQYATADAVQAVHIPEGTDLAEVAPILCAGITVYKALKSANLRAGHWVAISGAAGGLGSLAVQYAKAMGYRVVGIDGGPGKEELFTSLGGEVFIDFTKEKDIVGAVIKATDGGAHGIVNVSVSEAAIEASTRYCRANGTVVLVGLPAGAKCTSDVFNHVVKSISIVGSYVGNRADTREALDFFARGLVKSPIKVVGLSHLPEIYEKMEKGQIAGRYVVDTYK

SEQ ID NO: 20941 - protein, 707 aa, Burkholderia fungorum
MAGKTNTQKPAAKNAQASGPQSDPKAKDLEQFRVSPEGEALRTNQGVKISDNQNTLRAGPRGPSLLEDFIMREKITHFDHERIPERIVHARGSAAHGVFQVYESMQEYTKAAFLQDPAVQTPVYVRFSTVQGPRGSADTVRDVRGFAVKFYTQEGNYDLVGNNMPVFFIQDAIKFPDFVHAVKPEAPNEMPTGGSAHDTFWDFVSLVPESAHMVLWTMSDRAIPRSLRTMEGFGIHTFRFVNAQGKGRFVKFHWRPVLGSYSLLWDEAQKLAGKDPDFHRRDLWESIERGDFPEFELGVQIIEEADEHKFDFDLLDPTKLIPEEQVPVKIIGKMTLNRNPDNFFAETEQVAFHPGHVVPGIDFSNDPLLQGRLFSYTDTQISRLGGPNFHEIPINRPVCPFNNNQRDAMHRQTINVGQASYEPNSLSGGWPKETDPAPSDGGFETYQERVEGTKIRVRSESFADHFSQAALFYNSMSPPEKDHIAAAYQFELGKVTKPEIRARVVNEILANFDAGLAAQVAEGLGLPAPKKGTAKLTGPKESPALSLLNRVKPGIKTRKIALLAAPGSDGAAIKKLQQALQGEGATPMLIAPTLAAIDGMAPDATIAGLPSIMFDAVIVVGGDQGAKALAQSGDARHFVLEAFKHLKAIAAIGAGRDVLAAAHLPHNADGVATGDDKQAAEVLKAFIEAAGQHRVWSRAQQAETVPA

SEQ ID NO: 20942 - protein, 201 aa, Glycine max
MADQGLEGSQPVDLQKHPSGIVPTLQNIVSTVNLDCKLDLKTIALQARNAEYNPKRFAAVIMRIRDPKTTALIFASGKMMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 20943 - protein, 189 aa, Zea mays
  unsure (1)..(189): unsure at all Xaa locations
CSYVKDYEFVVIFDADFQPQPDFLKRTVPHFKGNEDVGLVQARWSFVNKDENLLTRLQNINLCFHFEVEQQVNGIFLNFFGFNGTAGVWRIKALEDSGGWMERTTVEDMDIAVRAHLKGWKFLFLNDVECQCELPESYEAYRKQQHRWHSGPMQLFRLCFVDIIKSKVMLGANXNLSFLFFFLLQVDFK

SEQ ID NO: 20944 - protein, 196 aa, Mitthyridium sp. Wall 2805
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTFDVSVVDLTVRLEKPASYDAIKAALKEASQGKMKGILGYTEDDVVSSDFITDSQSSIFDAKAGIALSDTFVNS

SEQ ID NO: 20945 - protein, 195 aa, Zea mays
GRGAEGDRSHRERPCLSRRVTVQEQISSSFMDSPPPPHLDAPLFGADLIPSGRLRRMRGWRHSPGGLEEEIRMFQTRVLLGGMNMYDRYQDWRLDVDNMTYEELLELGDKIGYVNTGLRDDEITRNLRKFKHPSFSSLRFATEMERKCSICQEEFETNEEMGRLDCGHSYHVYCIKQWLSQKNICPVCKTAVSKN

SEQ ID NO: 20946 - protein, 183 aa, Zea mays
  unsure (1)..(183): unsure at all Xaa locations
MVQASEVLSRETGVIVGDDILALFKHAQSEGYAIPAINVTSSSTVVAALEAARDAKSPIILQLSNGGAAYFAGKGVANGKQEASIAGSIAAAHYIRSIAPAYGIXXVVLHTDHCAKKLLPWLDGMMDADEAYFKAHGEALFSSHMIDLSEEPKEWNIATTKKYLERAAPMKQMIEMEIGITGG

SEQ ID NO: 20947 - protein, 220 aa, Dendrobium grex Madame Thong-IN
MGRGRVELKRIENKINRQVTFAKRRNGLLKKAYELSVLCDAEVALIVFSNRGRLFEFCSSTSMTKTLERYQKCSYNASESAVPSKDAQNSYHEYLTLKAKVEYLQRSQGNLLGEDLIELSSKELDQLELQLEMSLKQIRSTKTQLMLDQLCDIKRKEQMLHEANRALSMKLKEDGPEIPLELSWPGGETNGSSERQQPQSDKFFQPLPCSNPSLQIGYSP

SEQ ID NO: 20948 - protein, 184 aa, Zea mays
  unsure (1)..(184): unsure at all Xaa locations
MASSMLSSATVVSSPAQAAMVAPFTGLKSSAAFPVTRKTDTDITSMASNGGRVNCMKVWPPVGKKKFETLSYLPDLTDVELSKEXVDYLXFRNKWIPCVXEFELEHGFVYREHGNPPGYYDGRYWNNVXNFPWFRCTDSAXQVLKEVXEGKKEYPKRFLXILGFQKKRQGPGFFFFPQKPPNFR

SEQ ID NO: 20949 - protein, 163 aa, Zea mays
  unsure (1)..(163): unsure at all Xaa locations
ITMDPTKFRPSSSHDTTXVTTTNAGAPVGNDNEALTVGPRGAILLEDYHLIEKVAHFARERMPQRVGHARGAYDKGLYECTHDETALTCADLLRALGVRTXVIVRLSTAIHERGCPETIRDPRGFPVRLYTREDNWDLVGNNFPVFFIRDGIKFPDVIHAVKP

SEQ ID NO: 20950 - protein, 719 aa, Neurospora crassa
MRVNALLPLSGLIGTALAACPFADPSALGRRAEGGEVDARQRLKEVEVDDNGQFMTTDFGGNIEEQFSLKAGGRGSTLLEDFIFRQKLQHFDHERIPERVVHARGAGAHGIFTSYGDWSNITAASFLGAKDKQTPVFVRFSTVAGSRGSADTARDVHGFATRFYTDEGNFDIVGNNIPVFFIQDAIRFPDLIHSVKPSPDNEVPQAATAHDSAWDFFSSQPSALHTLFWAMSGNGIPRSYRHMDGFGIHTFRLVTEDGKSKLVKWHWKTKQGKAALVWEEAQVLAGKNADFHRQDLWDAIESGNAPSWELAVQLIDEDKAQAYGFDLLDPTKFLPEEFAPLQVLGEMTLNRNPMNYFAETEQISFQPGHIVRGVDFTEDPLLQGRLYSYLDTQLNRHRGPNFEQLPINRPVSGVHNNHRDGQGQAWIHKNIHHYSPSYLNKGYPAQANQTVGRGFFTTPGRTASGVLNRELSATFDDHYTQPRLFFNSLTPVEQQFVINAIRFEASHVTNEQVKKNVLEQLNKISNDVAKRVAVALGLEAPQPDPTYYHNNVTRGVSIFNESLPTIATLRVGVLSTTKGGSLDKAKALKEQLEKDGLKVTVIAEYLASGVDQTYSAADATAFDAVVVAEGAERVFSGKGAMSPLFPAGRPSQILTDGYRWGKPVAAVGSAKKALQSIGVEEKEAGVYAGAQDEVIKGVEEGLKVFKFLERFAVDGDDEE

SEQ ID NO: 20951 - protein, 344 aa, Brucella suis 1330
MAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCRHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 20952 - protein, 368 aa, Zea mays
MAPAKAQHTSTNQQTLLDAQLQLWHHAFGYVKSMALKAALDLGIPDAIHQHGGSATLPQIVTELATLHPSKTPCLRRLMRVLTLTGVFGVVVQHSTTDGGSDLVYELTPASRLLVGSAPSNGPNVSPFLNMILGTAFVSSFLDLGEWFQHELPDPSPFKLAHGRHVWDMARHDASFAKLCDSGMVADSRFIMDVMVEECADDVFRGISSLVDVAGGLGGAAQAIAKAFPHIDCSVLDLPNVVAAAPTSTDVKYIAGDMFQSIPAADVVFLKWVLHDWGDAECVKILQNCKKAIPSEGGKVIIMDIVVGAGSSDRKHVETQVLFDLFIMAINGAEREEEEWKKIIFEAGFSSYNIIPVLGVRSIIEVYP

SEQ ID NO: 20953 - protein, 473 aa, Antithamnion nipponicum
YESGVIPYAKMGYWDPEYVVKDTDILALFRVSPQPGVDPVEASAAVAGESSTATWTVVWTDLLTACDLYRAKAYKVDSVPNTTDQYFAYIAYDIDLFEEGSIANLTASIIGNVFGFKAVKALRLEDMRIPVAYLKTFQGPATGLIVERERMDKFGRPFLGATVKPKLGLSGKNYGRVVYEGLRGGLDFLKDDENINSQPFMRWKERFLYSMEAVNRSIAATGEVKGHYMNVTAATQEDMYERAEFAKQLGTVIIMIDLVIGYTSIQTMGIWARKNDMILHLHRAGNSTYSRQKIHGMNFRVICKWMRMAGVDHIHAGTVVGKLEGDPLMIKGFYDTLLESHLAVNLPLGIFFEQDWASLRKVTPVASGGIHCGQMHQLLDYLGNDVVLQFGGGTIGHPDGIQAGATANRVALEAMVIARNEQRDFVKEGPQILRDAAKTCGPLQTALDLWKDITFNYTSTDTADFVETPTANV

SEQ ID NO: 20954 - protein, 67 aa, Glycine max
MASSVISAPAGTTVNRAGAGMVAPFTGLKSMAGCPSRRTKNDVSSIASSGGRVQCMQVWPPVGREEV

SEQ ID NO: 20955 - protein, 207 aa, Magnetospirillum magnetotacticum
FADHGALLDPPTADVSARCVSVLSVLGERGKDKVAHEGVDYLLREQESDGSWFGRWGTNYVYGTWSSLCALNAAGLPHDHPAFRKAVKWLESKQREDGGWGECGRSYWDDQPRGMGGPSTPSQTAWAVLGLMAAGETNSQAVAKGIDYLIRTRNAEGLWDEEHYTAVGFPRVFYLRYHGYRQFFPVWALARYRNLTTGNAGPVMHAL

SEQ ID NO: 20956 - protein, 303 aa, Bacillus anthracis str. Ames
MPYFYVFLLLLTSLLWGGNFVVGKSLVDHASPMTLTSLRWIIAIVCLLPMVWFKEKKIIPPRAAILPLILMGISGVALFNIFQFLALEKTSATNVGLISTLNAISIALFSVLFLKEKVNTLQILSMILSFFGVILVLLKGNFALLFSLHFNSGDLWMIAAVCIWGIYSVCSKWATKTTTPLMATLYSGIFGVILLLPFNIGSFTVTNINTSFITSLLYTGLISTVLCMVFWNIGVQKLGATTSGIFLNFNPIFTAILAFLFLGEELTWIQIVGTMIVMTGCYLFSHFKTVTVQPTGTLLRKHS

SEQ ID NO: 20957 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELTIPPQIKLEQAKGFSLYMLRAIISGRGDEVIELAKTNWLR

SEQ ID NO: 20958 - protein, 359 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLFEELKLACKNIYAEDLFIRMERHILDTLDWDISIPTPASYIPVLDPIFFLVLDASMFVPNLFKFPASKIACSVMNIVNEHVGSFLLTHPSMESYRKDDNFLWPEDLDTVTSYMENMSKRYANEECTDLLFSSLGRISSILAKKYPEQCAMAAWCNMTEKDTERTL

SEQ ID NO: 20959 - protein, 277 aa, Rosa hybrid cultivar
ACENWGFFELVNHGISHELMDKVEKLTKEHYRKCVEQRFKEMVASKGLESVNSEIEDLDWESTFFLRHLPFSNISQIPDLDEDYREAMKEFAVELEKLAEKLLDLLCENLGLDKGYLKKAFYGSEGPNFGTKVSNYPPCPKPDLIKGLRAHTDAGGIILLFQDDKVSGLQLLKDDQWIDVPPMHHSIVINLGDQLEVITNGKYKSVMHRVIAQPDGNRMSIASFYNPGNDAFISPAPAMLEKQTEECPTYPKFVFDDYMKLYAGLKFQAKEPRFEAM

SEQ ID NO: 20960 - protein, 363 aa, Pisum sativum
CINSGINKVYILTQFNSASLNRHIARAYNSGTGVTFGDGYVEVLAATQTPGEQGKKWFQGSADAVRQFHWLFEDARSKDIEDVLILSGDHLYRMDYMDFVKDHRESGADITLSCLPMDDSRASDFGLMKIDNKGRILSFSEKPKGADPKAMQVDTTVLGLSKDEALEKPYIASMGVYVFKKEILLNLLRWRFPTANDFGSEVIPASAKEFYMKAYLFNDYWEDIGTIRSFFEANLALTEHPSKFSFYDAAKPMYTSRRNLPPSTIDNSKVVDSIISHGSFVNNAFIEHSVVGIRSRINSNVHLKDTVMLGADLYETEEEVAALLAEGRVPVGIGENTKIKDCIIDKNARIGKNVTIANSEGVP

SEQ ID NO: 20961 - protein, 288 aa, Streptococcus pneumoniae TIGR4
MSRQTPSLSFEVFPPNPAVGNDNIISALQDMQELAPHFISVTASNNKFNIKETTVRLADFIQNDLAIPTIAHLPAIYLTKDKVAETIADLDKVGVQKILALRGDIIPDVEPQKDFRYATDLIEFIKEQTPHFDIIGACYPEGHPDSPNQISDIQNLKKKVDAGCSSLVTQLFFDNERFYDFQDKCILAGIDVPIHAGIMPILNRNQALRLLKTCENIHLPRKFKAILDKYEHDPESLRAAGLAYAVDQIVDLVTQDVAGVHLYTMNNADTAKYIHQATHALFNHQSLG

SEQ ID NO: 20962 - protein, 227 aa, Nicotiana tabacum
ERVPERVVHARGASAKGFFEVTHDITHLTCADFLRAPGVQTPVIVRFSTVIHERGSPETLRDPRGFAVKFYTREGNFDLVGNNFPVFFIRDGMKFPDMVHALKPNPKSHIQENWRVLDFFSHVPESLHMFTFLFDDIGIPQDYRHMDGSGVHTFTLINKAGKSTYVKFHWKPTCGVKSLLEEEAARIGGANHSHATQDLYDSIAAGNYPEWKLFIQTMDPDHEDRFD

SEQ ID NO: 20963 - protein, 193 aa, Bifidobacterium longum NCC2705
MAQSDITIDALSKVGQQDAEYLVSLVRSVPGFPKEGIIFRDFMPVLADPKGLKILLKALEEALPVSPSEFDSIAGLESRGFLFGPVMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 20964 - protein, 405 aa, Triticum aestivum
  unsure (1)..(405): unsure at all Xaa locations
MGRGLALHPSIVSVSRVTSPRGMPGEGRAASLVCDELSIPAHLMTGTSXQLFDFIAAALAKFVASEGEDFHLLEGRQRELGFTFSFPVKQSSIASXGTLIKWTKGFSIDETVGADVVAELSSALDRQGLDMKVTALVNDTIGTLAGGRYDDNDVVAAVILGTGTNAAYVERANAIPKWHGLLPKSGDMVINMEWGNFRSSHLPLTEFDQALDTESLNPGEQIYEKLISGMYLGEIVRRVLLKMTEEASLFGDDIPPKLKIPFILRTPHMSMMHHDTSADLRTVGAKLKDVLGIQGTSLKTRRLVVAVCDIVAKRGARLAAAGIHGVLKKLGRDIPGSDKHRTVIAMDGGLYEHYTIFSETLENTLREMLGEEVSSSVVIKLANDGSGIGAALLAAAHSQYLEAEV

SEQ ID NO: 20965 - protein, 229 aa, Corylopsis sinensis
VQLKRMENKINRQVTFSKRRAGLLKKANEISVLCDAEVGLIVFSTKGKLYDMERIFDRYERYSYAERQLVVTNHESQGSWTIEHAKLKARMEVLQRNQRHFMGENLDSVSLKELQNLEHQLDNALKHIRSRKNLLMQESISELQRKDKSLQEENNSLSKKIKEKENALAHRAQWEQQNQGLNSFPILLSQPPQSLNIGTYQTGCSEGEEGTPFQQRPNTLLPHWMVSHL

SEQ ID NO: 20966 - protein, 285 aa, Spinacia oleracea
MSAASLCQSTLQSQINGFCGGLNIRKLQPSTSSPNSLTFTRRKVQTLVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCELASTIHLHRTVNQIKSLGAKAGVVLNPGTPLSTIEYVLDVVDLVLIMSVNPGFGGQSFIESQVKKISDLRKMCVEKGVNPWIEVDGGVTPANAYKVIEAGANALVAGSAVFGAKDYAEAIKGIKASKRPEPVAV

SEQ ID NO: 20967 - protein, 192 aa, Methanopyrus kandleri AV19
MRRLVLINNKDSFVYNLYHLFASYDLDLKVVSNKVPLSRLERLRPDGLVVSPGPGHPERDAGVSVPAIRRFAGEIPILGVCLGHQCIGVAYGAQIRRAKRIVHGKTSPIEHDGSGILSGLESPFQGMRYHSLVIEESSLPEELLPCAWSGDDGELMAVRHADYDVYGVQFHPESFMTEGGDRIARNFLELLG

SEQ ID NO: 20968 - protein, 84 aa, Zea mays
  unsure (1)..(84): unsure at all Xaa locations
SHRQPWIRGEHRPSSGSNSRFWTTNSGTPDWNNNSVLTVGQRGKILXEDYHVIEKIVRPHRERINEREENEKRFFVKGIFEENN

SEQ ID NO: 20969 - protein, 338 aa, Yarrowia lipolytica
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKNYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYPLK

SEQ ID NO: 20970 - protein, 214 aa, Elaeis guineensis
MVRGKTEMKLIENATSRQVTFSKRRNGLLKKAFELSVLCDAEVAVIVFSPRGKLYEFSSTSMEKTIDRYRRHAKSGINNNEVTQQWKFEAASMSRKIESLEVSKRKLLGENLESCSAEELHEIEGKIEQSLCHVRGKKNQLLEEQIATLKEQEQTLMEENALLREKCKLQSQLRPAAAPEETVPCSQDGENMEVETELYIGWPGRGRTNCRSQG

SEQ ID NO: 20971 - protein, 338 aa, Mycobacterium tuberculosis CDC1551
  unsure (1)..(338): unsure at all Xaa locations
MSAKLTDLQLLHELEPVVEKYLNRHLSMHKPWNPHDYIPWSDGKNYYALGGQDWDPDQSKLSDVAQVAMVQNLVTEDNLPSYHREIAMNMGMDGAWGQWVNRWTAEENRHGIXLRDYLVVTRSVDPVELEKLRLEVVNRGFSPGQNHQGHYFAESLTDSVLYVSFQELATRISHRNTGKACNDPVADQLMAKISADENLHMIFYRDVSEAAFDLVPNQAMKSLHLILSHFQMPGFQVPEFRRKAVVIAVGGVYDPRIHLDEVVMPVLKKWRIFEREDFTGEGAKLRDELALVIKDLELACDKFEVSKQRQLDREARTGKKVSAHELHKTAGKLAMSRR

SEQ ID NO: 20972 - protein, 519 aa, Citrus sinensis
MDLNGWCNSGNQNMCCCQSYVKRGYDRVLSFNGLITVSKLRGKRFKLPPGPLPVPVFGNWLQVGDDLNHRNLSDLAKKYGDVLLLRMGQRNLVVVSSPDHAKEVLHTQGVEFGSRTRNVVFDIFTGKGQDMVFTVYGEHWRKMRRIMTVPFFTNKVVQQQRFNWEDEAARVVEDVKKDPEAATNGIVLRRRLQLMMYNNMYRIMFDRRFESQDDPLFNRLKALNGERSRLAQSFEYNYGDFIPILRPFLRGYLKICKEVKERRLQLFKDYFVEERKKLASTKSMSNESLKCAIDHILDAQTKGEINEDNVLYIVENINVAAIETTLWSIEWGIAELVNHPEIQKKLRNELDTVLGPGHQITEPDTHKLPYLQAVIKETLRLRMAIPLLVPHMNLHDAKLGGYDVPAESKILVNAWWLANNPAQWKKPEEFRPERFLEEESKVEANGNDFRYLPFGVGRRSCPGIILALPILGITIGRLVQNFELLPPPGQSKIDTAEKGGQFSLHILKHSTIVAKPRSF

SEQ ID NO: 20973 - protein, 470 aa, Glycine max; identical to SEQ ID NO: 19570

SEQ ID NO: 20974 - protein, 356 aa, Oryza sativa; identical to SEQ ID NO: 12518

SEQ ID NO: 20975 - protein, 332 aa, Bradyrhizobium japonicum USDA 110
MQLGMIGLGRMGGNIVRRLMRHGHSTVVYDKDAKAVAGLAADGAVGSATLEEFVAKLERPRTAWVMLPAGRITETTIDTIAGVMQEGDVIIDGGNTFWQDDVRRGKALKARGIHYVDVGTSGGVWGLDRGYCMMIGGEKQVVDRLDPIFAALAPGAGDIPRTEGREGRDPRIEQGYIHAGPVGAGHFVKMIHNGIEYGLMQAYAEGFDILKNANIDALPADHRYDFDLADIAEVWRRGSVIPSWLLDLTSTALADSPALAEYSGFVEDSGEGRWTVNAAIDEAVPAEVLTAALYTRFRSRKEHTFAEKILSAMRAGFGGHKEPKQPGASKPK

SEQ ID NO: 20976 - protein, 373 aa, Sclerotinia sclerotiorum
MAETTTAAAEERQFVAHFSQKQHVSSPKEIQQNSRDKELGASSGSLSVRDFELVRTLGTGTFARVWLARLANPAEEDRDKVFALKVLRKVEVIKLKQVDHVNHERSVLADVAGHPFITTLITSFADHDSLYMLLDYCPGGEVFSYLRKAKRFDENTARFYAAEIVLILEFLHEREGVAYRDMKPENLLLDAEGHIKLVDFGFAKRLGNRETYTLCGTPEYLAPEVIQSKGHTTAVDWWALGILIYEFLTGYPPFWHSNPIEIYKQIVTKPVSFPAEPAISSAAKDIIRQFCTVDRSHRLGNISGGAARVKDHPFFQGVIWEDVYYRKYRGPIIPPLRYPGDAQNFDLYPDEKEGREPYTEELAAKWDDCFKEF

SEQ ID NO: 20977 - protein, 184 aa, Zea mays
  unsure (1)..(184): unsure at all Xaa locations
MHGRPRRPAKPEDDEAASAKAAKLRDLQAQVLHNHHARTYTKESIGLSFKLLETNPEAYTAWNYRKLALQHNVKELSDPQAIKSAIDDELRVAEVALRQNPKSYGAWYHRKWLLNQKLAPVDFKYELGLLDKLLKVDARNFHGWNYRRFLARFMGLPDDEELKYTMDKISDNFSNYSAWHXRSI

SEQ ID NO: 20978 - protein, 307 aa, Escherichia coli O157:H7 EDL933
MGSTRKGMLNVLIAAVLWGSSGVCAQYIMEQSQMSSQFLTMTRLIFAGLILLTLSFVHGDKIFSIINNHKDAISLLIFSVVGALTVQLTFLLTIEKSNAATATVLQFLSPTIIVAWFSLVRKSRPGILVFCAILTSLIGTFLLVTHGNPTSLSISPAALFWGIASAFTAAFYTTYPSTLIARYGTLPVVGWSMLIGGLILLPFYAGQGTNFIVNGSLILAFFYLVVIGTSLTFSLYLKGAQLIGGPKASILSCAEPLSSALLSLLLLGITFTLPDWLGTLLILSSVILISMDSRRRARKINRPARHE

SEQ ID NO: 20979 - protein, 498 aa, Nicotiana tabacum
MGKVVVGAAVVCTAAVCAAAVLLMRHKMENSGKWAKAMDILKEFEEKCETPIGKLRQVADAMTVEMHAGLASEGGSKLKMLISYVDNLPTGDETGLFYALDLGGTNFRVMRVQLGGKEKRIVKQEVKEVSIPKNVMAGSSSDALFDFIATTLVKFVATEGDDFHLPPGRQRELGFTFSFPVKQLSIASGTLIKWTKGFSIDDAVGQDVVRELTKAMERVGLDVRVAALINDTVGTLAGGRYNNPDVIAAVILGTGTNAAYVERANTIPKWHGLLPKSGDMVINMEWGNFRSSHLPVTEYDQSLDAESLNPGEQIYEKMISGMYLGEILRRVLCRMAEEASFFDDYVPPKLKTPFILRTQDMSAMHHDKSADLKVVGDKLKDILEVPNSTWKMRKIIVELCDIITSRGARLSAAGIVGILKKLGRDTLKDGEKQRSVIAVDGALFEHYTKFRNCMEGTIKELLGDAAENIVVKLSYDGSGVGAALLAASHSQYLGLKES

SEQ ID NO: 20980 - protein, 759 aa, Escherichia coli CFT073
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKSGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 20981 - protein, 158 aa, Glycine max
  unsure (1)..(158): unsure at all Xaa locations
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 20982 - protein, 628 aa, Nicotiana tabacum
MGRMSIPMMGFVVLCLWAVVAEGEYVKYKDPKQPVGARIKDLMKRMTLEEKIGQMTQIERKVATADVMKQNFIGSVLSGGGSVPAPKASAQVWTNMVDEIQKGSLSTRLGIPMIYGIDAVHGHNNVYGATIFPHNVGLGVTRDPDLVKRIGAATALEVRATGIPYAFAPCIAVCRNPRWGRCYESYSEDHRIVRSMTEIIPGLQGDLPAKSKNGVPYVGGKTKVAACAKHFVGDGGTLHGVDESNTVISSNSLFSIHMPAYYDSLRKGVATVMVSYSSWNGRKMHANRDLVTGFLKDKLKFRGFVISDWQGIDRITDPPHANYSYSVQAGIMAGIDMIMVPENYREFIDTLTSQVKANIIPMSRIDDAVKRILRVKFVMGLFENPMSDPSLANQLGSQEHRELAREAVRKSLVLLKNGKTPSQPLLPLPKKAPKILVAGTHADNLGYQCGGWTIEWQGVAGNDLTIGTTILTAIKKTVDPSTQVVYQQNPDANFVKSNKFSYAIVVVGEVPYAEMFGDSSNLTIAEPGPSTISNICGSVKCVVVVVSGRPVVLEPYVSKMDALVAAWLPGTEGQGVADALFGDYGFTGKLARTWFKRVDQLPMNFDDAHVDPLFPFGFGITTKPVKGY

SEQ ID NO: 20983 - protein, 616 aa, Glycine max
  unsure (1)..(616): unsure at all Xaa locations
MEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESNLILEIPKLXTSGCTESIEKGEQMWVKRIMSQSVLPNHITVLDLLKIPQLMDTCVRNGNYDEALDLEAFVGKLSTMHPKLPVIQALAAEVRLTTQSLLSQLLQKLRSNIQLPECLRIIGYLRRIGVFSEYGMRLLFLRCREAWLTGILEDLDQANPYEYLKGMINCHRMHLFDVVNQYRAIFADDTSGSEENYDGGLLFSWAMHQITSHLQTLKVMLPKITEGGSLSNILDQCMYCAMGLGWVGLDFRGLLPSLFEEAVLNLFSKNMSTAVENFQLVLDSHRWVPLPGVGFSAHTVGDENHEDVTPPSNLMEHPPLAVFINGVSAAMNELRPCAPISLKHVLAQELIKGLQAVSDSLLLYNTTRVLRSNESGLFLSLCWAFIEAAYPHCATCFGRCYLGGATLIMDAKNVYNGISRLLETSSARELPKPVNNVESKSVAENGESPKMENGETPDAKESEAVNSEEVNEEGTEEGPTLQTDREDTNLEKPLE

SEQ ID NO: 20984 - protein, 315 aa, Pseudomonas putida KT2440
MRVFSKAQIVAHFNPELAVSQLEEGFIAYSEGKVQVPPVQGFAFKGANGDCCVKSAYIEGSPTFTVKLSTGFYDNPSKGLPSNDGLMLVLSAHTGQPLALLQDQGWLTAMRTALAGRIAARLLAPSQVKAIGILGTGMQAQMQLEQLRAVTDCRQVIVWGRHERGLAAYTAFARELGFAVHSTQDAAEVAGAANLIVCTTPSRQALLHSDWVQPGTHITAVGADAPGKQELDPALVARADRIIVDAIAQCSQYGEVAHALGCGRIDANQLIELGTLLAGRAKGREHDSQITLADLTGVAVQDAQVASHALAALCT

SEQ ID NO: 20985 - protein, 91 aa, Brassica rapa
  unsure (1)..(91): unsure at all Xaa locations
LQVEEPKSYLKQSHHNYGHYNYNGSLKDLNHTVSVSSMDITVVPESXESDTTVQHPKETIDQLSGPPSQMVQQLTPEDREARVQRYREKKK

SEQ ID NO: 20986 - protein, 133 aa, Oenococcus oeni MCW
TDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAED

SEQ ID NO: 20987 - protein, 174 aa, Glycine max
MTTTPCVTGALSNAVGFRDWKKHVPLSASLCKLSFNSNIVDMKILSRCGCQKVGNDQRCFRLYALFGGKKDNSGKSDDAPSKAGILGNMQNLYETVKKAQMVVQVEAVRVQKELAAAEFDGYCEGELVKVTLSGNQQPVRTEITEAAMELGPEKLSLLITEASKDAHQKECPGP

SEQ ID NO: 20988 - protein, 488 aa, Asterosiphon dichtomus
MSKNVQERTRIKSERYESGVIPYAKMGYWDADYNVKHTDVLSLFRITPQPGVDPVEAAAAVAGESSTATWTVVWTDLLTACDIYRAKAYRVDPVPGTTDQFFAYIAYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRASAATGEVKGSYLNATAGSMEEMYTRAEYAKQVGSIIVMIDLVIGYTAIQSMAIWSRANDMILHLHRAGNSTYARQKNHGINFRVICKWMRMSGVDHIHAGTVVGKLEGDPLMVKGFYNVLLESKLDINLPQGLFFEMDWAALRKTVPVASGGIHCGQMHQLLYYLGDDVVLQFGGGTIGHPDGIQAGATANRVALEAMVLARNEGRDYLNEGPQILRDAAKMCGPLKTALDLWKDITFDYTSTDTPDFVETATESK

SEQ ID NO: 20989 - protein, 472 aa, Triticum aestivum
  unsure (1)..(472): unsure at all Xaa locations
MAARKDNAVLIACQAPNGRVTRAQAANRGRFGVPHPAPVPVRTERKPATKGKAKRGASDENTCASALTSAPPPKRRAALKDVTNISCANSFRNCTAVTKLQSRPTQKVGRNPSKNKQCTKKAPKPPLPAVSGTSFVVNDSHNVEESQKAELLPPKEEPTALLENKGSLSLWNIARNRESGVHEPFFQGRNTRDKSETADSNTGYYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAXELTLTDYSFLKFHPSVVAASAVFLAKWTLDQSDLPWNSTLEHYTSYKSSDIQGCVRDLWELQQGNTSGSPPLNAIREKYRQ

SEQ ID NO: 20990 - protein, 468 aa, Desmarestia tabacoides
IPYAKMGYWDADYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGVIVERERLDKFGRPLLGATVKPKLGLSGKNYGRVVYEGLRGGLDFLKDDENINSQPFMRWKERYLYCMEGVNRAAAATGEVKGSYLNVTAATIDQMYERAEYAHAIGSVIVMVDLVIGYTAIQTMAIWARKAEMILHLHRAGNSTYARQKNHGINFRVICKWMRMCGVDHIHAGTVVGKLEGDPLMVRGFYNTLLLTQLKVNLAEGLFFDMDWASLRKCVPVASGGIHCGQMHQLLYYLGDDVVLQFGGGTIGHPDGIQAGATANRVALEAVVLARNEGRDYVGEGPEILRNAASTCGPLKAALDLWKDITFEYTSTDTPDFVEVATESK

SEQ ID NO: 20991 - protein, 408 aa, Flaveria pringlei
MESRVLSSGATTISGIPRLTRPAGRTTTTTVVAVASPAKLNTNGGNLVWGRQLRPSLLNLDHSSPVSLVTKPVKRDVLKPCTATASDSAGDAAPVGFFAKYPFLVTGFFFFMWYFLNVIFNILNKKIYNYFPYPYFVSAIHLAVGVVYCLGGWAVGLPKRAPMDSNLLKLLIPVAFCHALGHVTSNVSFAAVAVSFTHTIKSLEPFFNAAASQFILGQSIPITLWLSLAPVVIGVSMASLTELSFNWLGFISAMISNISFTYRSIYSKKAMTDMDSTNLYAYISIISLLFCIPPAIILEGPQLLKHGFSDAIAKVGMTKFISDLFWVGMFYHLYNQLAINTLERVAPLTHAVGNVLKRVFVIGFSIIVFGNKISTQTAIGTSIAIAGVAVYSLIKAKIEEEKRGLKSA

SEQ ID NO: 20992 - protein, 157 aa, Zea mays
MAAAATATPSVAPESGDRKAVAPPVDAVDLELELEEKHVLAVDDSSVDRAVIAKILRSSKYRVTTVDSATRALELLALGLVPDVNMIITDYWMPGMTGYELLKHVKESSALRAIPVVIMSSENVPTRISRCLEEGAEDFLLKPVRPADVSRLCSRIR

SEQ ID NO: 20993 - protein, 434 aa, Pyrobaculum aerophilum str. IM2
MTEKWYQLSVEIHRKYGGKISITPKVPIRSMDDFAIYYTPGIAEVSRQIHKNPELAFELTSRWNIIGVITDGTRVLGLGNIGPEAAYPVMEGKALIFKYLGGVDAVPIPIRVKTQEEFVFVAKALEPALGGINLEDIESPKCFYLLERLREELRIPVWHDDQQGTATATLAGLINALKLVGKKISDVTIALIGAGASNIYTARILIKYGAKPGNLILVDSRGILHPERDDIDKLMIENPWKYKYAIETNAERRKGGIPEAMRGADVVIAASSPGPGVIKKEWVASMNKDAIVFALANPVPEIWPWEAKEAGAKIVATGRSDFPNQVNNSLIFPAVFRGALDVRATAITDEMLIAAAEEVAKFAEEKGIHEEYIIPKMTEWEVYVREAAAVAATASAQKVARIPRSYKEELEIAGSIIGKSIKMLEVLMMEKIIE

SEQ ID NO: 20994 - protein, 482 aa, Zea mays
MRIVCGCRGSTVHLHHLSSSSSPPPLPFHLLPPGDSSSSLPRRSIGPPIDRARGRRFQSGVVSIRSGSLPVWVGAMAAMDASADKNAVFRKLRAKSDNKMCFDCNAKNPTWASVTYGVFLCIDCSAAHRSLGVHVSFVRSTNLDSWTPEQLKMMVYGGNNRAQAFFKQHGWTDGGKIEAKYTSRAADLYRQLLAKDVAKSSTEDGNNSWPSSPVAASQAPNQAAAFPDLKLTEVSKENVSEKKDSEIVRSPRAPTHSFKKPIGAKKPGNKTGGLGARKLTSKPNESLYEQKPEEPAPVLPSSVIESTTTRSKSHTSRFDYVENAPALKNGNSSEGNHMSGHVAPPMSSNFFAEFGMDSGYHKKSTSSSSKVQIEESREARQKFSNAKSISSSQFFGDQASFEKDAQVSLQKFSGSSAISSADLFGHPANNSSVDLSASDLINRISFQATQDLSSLKNMAGETGKKLTSMASNIITDLQDRIL

SEQ ID NO: 20995 - protein, 265 aa, Haemophilus influenzae Rd
MTGAQLIMACLKAHHVTTLFGYPGGAIMPTYDALYDAGLDHLLCRNEQGTAMAAIGYARSTGKVGVCIATSGPGATNLVIGLGDAMMDSIPVVTITGQVASPLIGTDAFQEADVLGLSLACTKHSFIVQSADVALQGDLIQALNALKQDLDIEPWREQIRNFKAKLDFTYVENQGNRPIDPWALLNSLSNRKPNNAIICTDVGQHQMWLVQHILRVARHCGFTVTTMEMTLIETQVRLKITVKSDRTLDLLVNQLVKLPDVLMVN

SEQ ID NO: 20996 - protein, 427 aa, Paralemanea catenata
IEASAAIAGESSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLRGGLDFLKDDENINSQPFMRWRERYLFSIEGVNRAQAAAGEIKGHYLNVTAATMEDMYERAEFAKELGSIICMIDLVIGYTAIQSMAIWARKTDMILHLHRAGNSTYSRQKIHGMNFRVICKWMRMAGVDHIHAGTVVGKLEGDPLMIKGFYDTLLLSHLDINLPHGIFFEQDWASLRKVTPVASGGIHCGQMHQLLDYLGDDVVLQFGGGTIGHPDGIQAGATANRVALESMVMARNEGRDYVTEGPQILRDAAKTCGPLQTALDLWKDISFNYTSTDTADFV

SEQ ID NO: 20997 - protein, 338 aa, GIBBERELLA ZEAE PH-1
MAPIKVGINGFGRIGRIVFRNAVEHPDIEVVAVNDPFIEPHYAVYMLKYDSSHGIFKGEVGNQGNDLVVNGKTIKFYSERDPANIKWSETGADYVVESTGVFTTIDKAKAHLQGGAKKVIISAPSADAPMYVVGVNENKYDGSADIISNASCTTNCLAPLAKVINDKFGIVEGLMTTVHSYTATQKTVDGPSSKDWRGGRGAAQNIIPSSTGAAKAVGKVIPELNGKLTGMSMRVPTANVSVVDLTVRLEKGASYDQIKQVIKEASEGDLKGVLAYTEDDVVSSDLNGNTNSSIFDAKAGISLNDNFVKLVSWYDNEWGYSRRVLDLLAHVAKVDASK

SEQ ID NO: 20998 - protein, 296 aa, Haemophilus somnus 129PT
MNMSYTKELDTLNQHMVDINGKINVSFEFFPPKNEKMETLLWDSIHRLKVLKPKFVSVTYGANSGERDRTHAVVKRIKQETGLEAAPHLTGIDATPEELKAIAKDYWDGGIRRIVALRGDEPKGYIKKPFYASDLVELLRSVADFDISVAAYPEVHPEAKSAQADLINLKRKIDAGANHVITQFFFDVDSYLRFRDRCASIGIDAEIVPGILPVTNFKQLQKMAAITNVKIPSWMAKMYEGLDDDQTTRNLVAASIAMDMVKVLSCEGVKDFHFYTLNRSELSYAICHTLGVRPSL

SEQ ID NO: 20999 - protein, 328 aa, Zea mays
SLPSRELRSREARKKEKWRSLVETYACSPATERGRGILLAGDPKTDTIAYCTGRSVIIRRLDAPLDTWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSAS

SEQ ID NO: 21000 - protein, 508 aa, Shewanella oneidensis MR-1
MQNHSNLNDIGVIGLGVMGKNLALNIADNQYRVSVFDLDPVKVNGVLQQEKQERVGQELRITGCANLSEMLASLTKPRILVLSVPAGAPVDGVCAALISAGIEADDIVIDTGNSLWTDTVEREQHYQGQFIFFSSAVSGGEVGARFGPSLMPSGDLGAWQHVAPIWKAIAAKVNPQTGLPIERFEPGNPVTEGEPCTTYIGPAGAGHYVKMVHNGIEYADMQLICEAYQLLHDGLGMSAAEVGEVFERWNQGSLNSYLMGISAEVLKQADPLTGKPLVEMILDKAGQKGTGLWTAVSSLQIGCPAPTIAEAVYARAVSTQKSLRVELSKKLAGPLSPAMDENQKANLIDALESALYCAKVCCYAQGFQLMAMTALEQKWQLDFAEIAKIWRAGCIIRATFLQSITQAYQADANLSCLLMADTFASTLSEKQTEWRIAVAAAIMQGIPVPCISSALAYYDSYRSETLPANLLQGQRDFFGAHTFERLDKPAGEKYHLDWSAQERVLIKL

SEQ ID NO: 21001 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQKHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 21002 - protein, 336 aa, Rhodospirillum rubrum
MTQKREVLAMSETKLDALRRHTIIVADSGDIDAIRSFAPQDCTTNPSLILKAAKMPAYAGLIAQAIEAGSAEAGPSEGLIDRILDHLAVTFGSELARIVPGVVSTEVDARLSFDTQATVARAERLIGLYAARGVAAERILIKVAATWEGIRAVEILQSRGIACNVTLVFSLAQAVAAAEAGAFLISPFVGRILDWHVKASGKSFDIDEDPGVRSVTEIYTYFKHFGYKTIVMGASFRSSAEVEALCGCDRLTVSPALLDQLRSQTGDVPKRLDPAASKAATISRLAVDEASFRWQINEDALATEKLAEGIRLFNADTDALRRTIAETLAKRASTVA

SEQ ID NO: 21003 - protein, 298 aa, Candidatus Blochmannia floridanus
MSIFHATQQEILNQYLVELRGHVKVSFEFFPPKTDTMEGMLWNSINKLSRFNPDFVSVTYGANSGKRDNTNRIIQDIKKRTSLIAAPHLTCIDFTPSMLRDIAQEYWNNGVRNIIALRGDKSINKCSSLSSMYAVDLVSLLKKIGDFDITVAAYPEVHPEARTAQSDLINLKRKIDAGANRAITQFFFDVEQYLRFRDACVSIGIEIEIIPGILPIFDFYQLQRFVAFTKVRIPQWMYILFDGLEHDLDTQKLIGIAVAMDMVKILVKEGVRNFHFYTLNRSDLTYTICHALGVKASN

SEQ ID NO: 21004 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 21005 - protein, 482 aa, Tropheryma whipplei str. Twist
MGRGQRCCVFENAKEAAEYIKSNQIEVLDVRFCDFLGAQHHFAVPAHAVDDEFFQSPQVFDASSLRGYADINHSDMLLVADPSTSYIDPFRHHKTLAMIFDVHDPRTGDVYERDSRNVAKKAEKYLAGCRFADTAYFAAEAEFFIFDDVRFKISNHSSSYSVDSEEGIWNSSRRKGGGNLGNQLKHKGGYAPLPPADQHADLRDDIMNALTKVGLRVEKGHHEAGSAGQGEINYRFNTLVNAADDLLKFKYVVKNTAHEWGKSATFMPKPIAGDNGSGMHTHQSLWKNGKPLFYSETGYANLSDIALWYIGGLLKHGPALAAFTNPSTNSYKRLVAGFEAPTSLVYSAGNRSAAIRIPPTIGAEGSKRIEYRVPDSSSNPYLAFSALLMAGIDGIKNKIHPGSPVEQNMYELTKEQSRDLRYLPSSLSDALRALEQDCDFLLEGNVFTREFISAWIDYKRKNELNRIAQYPHPLEFGMYYGV

SEQ ID NO: 21006 - protein, 524 aa, Arabidopsis thaliana
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKPKVDAGYPPGIGVKNSLIMLGVLNFIGMLFTFLVPEPKGKSLEELSGEAEVSHDEK

SEQ ID NO: 21007 - protein, 499 aa, Azotobacter vinelandii
MQASNDTRSNYAPDSSYGLFIDNQWVAGENGETITILNPANGKTLTGIPNATAVDVDRAVQAAQRAFEAWRSTTPIERANALLKIADLLEADAERFAALESLDVGKPIRESSSVDIPLAIDHFRYFAGVIRSHSDEAVMLDEQTLSIVLSEPLGVVGQVIPWNFPLLMAAWKIAPAIAIGNTVVIKPSELTPVSILELAKIFAQVLPAGVVNIVTGTGASAGQALLDHPDVRKLAFTGSTSVGHRVADAAAKKLIPATLELGGKSANIVFPDANWDKAVEGAALAILWNQGQVCESGARLFVHESIYERFLDEVKQKFEAVRVGDPLHPDTMMGAQVSKTQMERILGYVDIAKQEGAKVLLGGGRLTGADYDAGFFIQPTILVDVRNDMRVAYEEIFGPVLCVIPFKDEADVIAMANDSEYGLAGAVWTQDINRALRVARAVETGRMWVNTYHEIPAHAPFGGYKKSGLGRETHKSILEAYSQKKNIYVSLNEAPLGLF

SEQ ID NO: 21008 - protein, 288 aa, Escherichia coli
IGQALALLLKTQLPSGSELSLYDIAPVTPGVAVDLSHIPTAVKIKGFSGEDATPALEGANVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKRGGGSATLSMGQAAARFGLSLVRALQGEQGVVECAYVEGDGQYARFFSQPLLLGKNGVEERKSIGTLSAFEQNALEGMLDTL

SEQ ID NO: 21009 - protein, 203 aa, Oryza sativa
MGVQEVLSRKSGVIVGDDVLRLFEYAREHKFAIPAINVTSSSTVVAALEAARDAKAPVILQFSQGGAAYFAGKGVSNGDQAASIAGSVAAAHYVRSLAPTYGIPVVLHTDHCAKKLLPWLDGMLDADEAYFKEKGEPLFSSHMIDLSEEPVEWNIETTAKYLKRAAPMEQWLEMEIGITGGEEDGVNNEDVDNNSLYTQPEDI

SEQ ID NO: 21010 - protein, 365 aa, Saccharum officinarum
MGSLASERKVVGWAARDATGHLAPYTYTLRSTGPEDVVVKVLYCGICHTDIHQAKNHLGASKYPMVPGHEVVGEVVEVGPEVTKYGVGDVVGVGVIVGCCRECKPCKANVEQYCNKKIWSYNDVYTDGRPTQGGFASTMVVDQKFVMKIPAGLAPEQAAPLLCAGVTVYSPLKAFGLTTPGLRGAILGLGGVGHMGVKVAKAMGHHVTVISSSSKKRAEAMDHLGADAYLVSSDAAAMAAAADSLDYIIDTVPVHHPLEPYLALLKLDGKHVLLGVIGEPLSFVSPMVMLGRKAITGSFIGSIDETAEVLQFCVDKGLTSQIEVVKMGYVNEALDRLERNDVRYRFVVDVAGSNVEEVAADAPSN

SEQ ID NO: 21011 - protein, 590 aa, Zymomonas mobilis
MNSSLFSDSLVILGAAGLIIPAFARFRISPVIGFILAGAVLGPKALGSLVTEYPWLKHITISDPDGIEPFADFGIVLMLFSIGIELSFKRLWAMRQAVFGLGTGKLLGCGFLIGAGLYALGENWAGAIGMGTGSQRIVNRFGAASSGNNGTCRKKPFAILLFEDLALVPIIFALVPWHLMGKIIAGTDLIATIWQGGATVIAILVLGRFALPTLFAQAARTKSAEVFLSISLLVVILASVATSAMGLSPIVGALTAGLLIAETDYHVEVEMVILPFQRLALGVFLLTVGMSLDLRLIMANWQALALGVAGVVLVKTLVTSTLLRLSHVRLATAVESCLLMSAPSETTLVILATARQAQLIMPSTAAFWEIVTAIGLTITPHLAKISHKVSLKLTLREHNLTLPSNEEPIEDIQNHTIVAGIGRVGKVIADVLTSEKKPYLAIDSDIDLVINAKRDGYHATFGDISNPVFIQQLGNKINAVVLAINDPVSMVNVVHRLHTIYPDLTIIARASDSRHAAQLFRAGATDIVAETLESSLRLAEATLISLGVSTGHAVAAIHDKRASMRENVLKAAEEGNMQAIRHTPSIMPEA

SEQ ID NO: 21012 - protein, 513 aa, Oryza sativa
MSASRPDHRRHHPPFLRDLSSPISSAVRLPPASLRRETQGSTTPPPPPPALLFLDDLSHHSPSPRPATPPQAAAMSPSPPPPHRGGLFSSTPLRSNGSPFPAAWWSSSREEMAREGSPVDGVVQPQQQPSPTTASGQQSQQQKVTLITLPPPREVARPEMPKDSTPSAGRVDEEEWVTVFGFLPGDTNLVLREFEKCGIVLRHVPGPRDANWMHILYQSRHDAQKALTKHGQQLNSVLIIGVKQVDPWQRQYLNEKTNENFQVGATDPFPSQHVAPSSFTTRNALAPLPSNSMPNGIGNGSGRGASGAIASPTKSVLSKVMDLIICIVPSLRSSGCHTGISPGRSGASVDGVSLIKSDCLVKRKKNILDLCLKLHQYCRVAMRSVRIHASYVYSRPESRRITSMCHHFLAVDEHCHRNNPLLSLNQFLPLDQTYTLLSDCEVRAIFSSKPDVAVVLPIRFREEIKDEPHAATHIITPILIKAKWPCALSVLNQAKLRLITPHVRHPGRQLIII

SEQ ID NO: 21013 - protein, 674 aa, Neurospora crassa
MLLTRYLASATALLASSALAQITTDCQPLNKTCPADPALGMDYSWTFNSTPKAWAWETTVGTVDFDMDQGAAFTISKQGDSPTLRSKFYFFWGRTEIWMKAAQGRGIVSSVMFLSDDLDEIDWEFVGGEPNNVQTNTYGKGVIESSIPGKHDVSGNAQEDFHNYTTIWTRDYLDFYVDGNKVRTLLPAQANNTQFYPQTPMRLSFGIWAGGDPRMAKGTQDWAGGQTDYGAGPYTMHVKSVQVTDFSEGQEYVYGDRSGAWESIKVVEGNSTVKEMIMAPPKQSVSDKWNGMSSTTKTIIYACCAGVGALLLFAAVFVCIRTRRRGARQAALAEAQYQRDRLELEQLQKAGIDPDSFREQAAEYHADEMKKDGMATTTTYSVPPSPPLDDSNNTSGGQFNTASAVGAGVAAGAALGATGAAAASLSQSPRVASPAPAPGQQQQQQQHQQQFNSFDNNMNRVASPALSPGQQQQQFNFFDNNMNMDRVASPAPSIPALTPTIPNVTGGYQSQAHSPVFPPNRSFTSPVPGPYNPQGPMYGSDMNRVGSPAPGGGLVHPQPQRSFTAGPTAPGFASPQSASFDFSNNNNNHGGYANSPQASTFAGAYGQQPAGSGLGIQSGGAAAGYGHASGGVGQVPDFGLPGQNGFAEGRDSYWGDTRDDDHHNQGHMNNGGYR

SEQ ID NO: 21014 - protein, 472 aa, Leptospira interrogans serovar lai str. 56601
MDSLKSKSDELIQNKMTSEGLSSAFIQDFLKKTDLVRNGETGMVRWEEVGDLDPKADEITLEQIESENAPEPSILKNLVVIKLNGGLGTSMGLSGPKSLIELKNGMSFLEIVAKQSEVIEKKYNVSVPLILMDSFNTQKESQEELNRIGFRQKFPTSFLQHKVPRLLKKDLTPISCKNPDEEWCPPGHGDIWISLLETGLLDTLIQNGYKIAFVSNGDNLGATVHPGILSYMLKEKLEFCMEMTPKTLADKKGGAIYKRMVAGRAENYQLLETAQVPPEHMHEFEGLGKFRTFSTNNLWIDLVALRQRILLGSFELSLIVNPKTIEGQEVLQLETAMGSAIRNFEKVKGIIIPRDRFAPVKKCEDYLARRSDAYHLLENYSITMSDKRKESGLGEILIYLDERYYKKIGDFNRLFPEIPSLELCSSLTVQGEVLFDQKISIVGEVVIQNNETLPRRISDLKTRILESGKYSF

SEQ ID NO: 21015 - protein, 136 aa, Oryza sativa
  unsure (1)..(136): unsure at all Xaa locations
GAGLRPSVLXGILVTGXYYSDXXXGQTTIFSYSEXQRXRLGPNYLLLXPIAPXXAHHNYHYDGFMNFMRRDXEVDYXPSXYXPAXXAPRYXIPSATLXXXRXXVVXXNENNXPQPGERYRXWDPARQDRFIXKWID

SEQ ID NO: 21016 - protein, 214 aa, Zea mays
METFTQEHVIGIPLTSFAYADEERQGKSSCSAMVHKKNKKSSFIHRMNKLSHKTDSYMQGFKEHLTMGPKISETIKGKLSFGAKVLQAGGIDKVFREYFAVEKDEKLRKAFQCYLSTTAGPIAGMLFISTKKIAFHSDRPLSFTSPKGGSTRVPYKVLIPTERMKSASVRENLYNPDEKYIDVVTVDGFDFWFMGFVSYEKSFKYLQQVIMELR

SEQ ID NO: 21017 - protein, 318 aa, Saccharomyces cerevisiae
MSSNAQVKTPLPPAPAPKKESNFLIDFLMGGVSAAVAKTAASPIERVKLLIQNQDEMIKQGTLDKKYSGIVDCFKRTAKQEGLISFWRGNTANVIRYFPTQALNFAFKDKIKLMFGFKKEEGYGKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 21018 - protein, 540 aa, Zea mays subsp. mays
MGLGVVAELVRLGVLSSTSDHASVVSINLFVALLCACIVLGHLLEENRWVNESTALIVGLGTGTVILMISRGVVIHVLVFSEDLFFFYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 21019 - protein, 116 aa, Glycine max
SVADPAQLTVTPSRHEKSLGLLTSKFVSLLQEAEDGVLDLKAAADTLAVRQKRRIYDITNVLEGIGLIEKKSKNSIQWKGVGPGCNTREIADKLIDLKAELADLEQREQELDQQRV

SEQ ID NO: 21020 - protein, 810 aa, Pisum sativum
MIFSRIGRALSRSSRVKNLLHGDSRLGALSGVPRIDVYSEGVEGGLGFFRGYVSSSVARNNGFVSNLSGFKSVAGNPRFLRLFSSEAPKKKNYENFYPKGQKEVPKGGDKKNESKEDSKSNTEDQGGFQEAFMKQFQSFLTPLLVMGLFLSSFSFGPREQQQISFQEFKNKLLEPGLVDHIVVSNKSVAKIYVRNSPRDQADSEVLQGNLPAKGSSGHYKYYFNIGSVESFEEKLEEVQETLGVDPHDNVPVTYSSELVWYQELMRFAPTLLLLGTLLYMGRRMQGGFGVGGGGGGKGARGIFNIGKAHVTKVDKNAKNKVYFKDVAGCDEAKQEIMEFVHFLKNPKKYEELGAKIPKGALLVGPPGTGKTLLAKATAGESGVPFLSISGSDFMEMFVGVGPSRVRNLFQEARQCAPSIIFIDEIDAIGRKRGRGGFSGSNDERESTLNQLLVEMDGFGTTAGVVVLAGTNRPDILDNALLRPGRFDRQITIDVPDIKGRDQIFQIYLKTIKLDHEPSYYSQRLAALTPGFAGADIANVCNEAALIAARTDEAQVTMDHFEAAIDRIIGGLEKKNKVISKLERRTVAYHEAGHAVTGWFLEHTDPLLKVTIVPRGTAALGFAQYVPNENLLKTKEQLFDMTCMTLGGRAAEKVLIGTISTGAQNDLEKVTKMTYAQVAVYGFSEKVGLLSFPQREDSMEMTKPYSSKTGAIIDTEVREWVNKAYERTIQLIEEHKAKVAEIAELLLEKEVLHQEDLLRVLGERPFQSAEPTHYDRFKLGFQDEEKVVETTVNEAKDDGGSSPLEPEVVPT

SEQ ID NO: 21021 - protein, 575 aa, Neisseria meningitidis Z2491
MQLSGAQIIVQSLKAEGVEYVFGYPGGAVIEIYDALFQLNKFKHILTRHEQAAVHAADAYARVSGKVGVALVTSGPGVTNALTGIATAYTDSIPMVVISGQVGNSLIGTDAFQEVDTVGITRPCVKHNFLVTDINELAETIKKAFQIAASGRPGPVVVDVPKDVTQAMAKFSYPQEDIFIRSYQPVVQGHIGQIKKAVQMLASAKRPVVYFGGGVVLGNASEELTRFVRMTGAPCTGTLMGLGAYPSGDRQFLGMLGMHGTYEANLAMQNADVVLAVGARFDDRVVSVPSKFFEKAKKVIHIDVDPSSIAKRVKADIPIVGDVKNVLSEMVALWQKQESVPSEDALGKWWKTIEEWRSRDCLWFDNGSEIIKPQYVIQKLAEITGNSAIITSDVGQHQMFAAQYYPFERPRQWLNSGGLGTMGVGLPYAIGAKLAAPDQDVFCITGDGSIQMNIQELSTCFQYRIPVNVITLNNGYLGMVRQWQEIYYGGRESETYFDSLPDFVKLAEAYGHIGIRVDKKSDVEGALLEALNQKDRLVFIDFLTDQKQNVMPMVGNGKGLDEMVLPPHMRADGKA

SEQ ID NO: 21022 - protein, 295 aa, Chlorobium tepidum TLS
MGSNMVEHLLELGHEVVAFDLSAEAVKAIAAKGATAASSLQHLVGELAAPRVVWMMVPAGRPVDAVIDGLTPFLRAGDIVIDGGNSRYTDSVARAEKLRKQGIRMLDIGTSGGLDGARHGACMMAGGDREAYEHVEPVLRDLCVENGYGYMGASGSGHFVKMVHNGIEYGMMQAIGEGFELLRASGYDLDNQNVARVWSNGSVIRGWLMDLAGKAFAQGNDLGWLGGKVADSGEGRWTVEAAIELGVAVPIISGSLFRRFQSQNEEHFSDKVVAALRHEFGGHAYEKPGEGEGKA

SEQ ID NO: 21023 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 21024 - protein, 319 aa, Staphylococcus epidermidis ATCC 12228
MRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSADMLYQPENIDDIQVFQDDILHFCSVDLIESDMKYAHEKMIEKFESVDGTIVFDPNVRLPLWEDKLECQRTINAFIPKAHIVKISDEELLFITGKRNEDEAIQSLFRGRVNVVIYTQGAQGATIYTKDDYRIHHEGYQVQAIDTTGAGDAFIGAIIYCILESRYSECKDLFKEKGKDILAFSNRVAALTTTKHGAIESLPTKEDIKDYN

SEQ ID NO: 21025 - protein, 839 aa, Oryza sativa
IFQQLPEERSSTSTFSATCAFQQGQYPVTKGTLDVSSKGAKLSVMPFNFGNGRPPLVPHDTEIVSSLCKTMEEQSQLASEENLQVAQHQLLKEDLKKVVVNASDISDSFDSFPYYLSENTKNALLSSAYVNLCCKESIKWTKHISSLCQRVLLSGPAGSEIYQESLVKALTKHFGAKLLIIDPSLLASGQSSKSKESESYKKVKFAGDCSSFFQNIYDDNKTTTSMLLMVFSGDRVRYIGSVQSTGIILEGQRAPDYGSQGEVRLPFEENESSKVGVRFDKKIPGGIDLGGNCEVDRGFFCPVDSLCLDGPGWEDRAKHPFDVIYEFASEESQHGPLILFLKDVEKMCGNSYSYHGLKNKIESFPAGVFIVGSQIHTDSRKDKDSFGRVNDKNKEALKIAKHLTKLFPNKVTIQTPQWKQLLDRDVEILKAKANTSKIQSFLTRNGLECADIETSACVKDRILTNECVDKVVGYALSHQFKHSTIPTRENDGLLALSGESLKHGVELLDSMQSDPKKKSTKKSLKDVTTENEFEKRLLGDVIPPDEIGVTFEDIGALENVKETLKELVMLPLQRPELFSKGQLMKPCKGILLFGPPGTGKTMLAKAVATEAGANFINISMSSIASKWFGEGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKERASAEAENKPLPPPRSSSDVRSLRMNDFKHAHEQEKKMRKREKQKETQATTRSDVSKLAISNKRIDGFHFHLKHYV

SEQ ID NO: 21026 - protein, 682 aa, Arabidopsis thaliana
MSRSQNEEFQQWWNKQRDRNNHDVLYAGDDEAFLTVEIRTPATVDPDKDRIRTRTVRQLSRLYLLKFKQLASSFLWIGNSFLYLVRTANRRIANDNPPSVSSSARLYRLIKGFLVVVVLLLCFELAAYFKGWHFTPPSVASAEVAVEVVYAWWLEIRASYLAPPLQSLTNVCIVLFLIQSVDRLVLVLGCFWIKLRRIKPVASMEYPTKLVGEGVRLEDYPMVIVQIPMCNEKEVYQQSIGAVCMLDWPRERMLVQVLDDSSELDVQQLIKAEVQKWQQRGVRIVYRHRLIRTGYKAGNLKAAMNCEYVKDYEFVAIFDADFQPPADFLKKTVPHFKGNEELALVQTRWAFVNKDENLLTRLQNINLSFHFEVEQQVNGVFINFFGFNGTAGVWRIKALEDCGGWLERTTVEDMDIAVRAHLCGWKFIYLNDVKCLCELPESYEAYKKQQYRWHSGPMQLFRLCFFDILRSKVSAAKKANMIFLFFLLRKLILPFYSFTLFCVILPLTMFFPEANLPSWVVCYIPGIMSILNIIPAPRSFPFIVPYLLFENTMSVTKFGAMISGLFKFDSSYEWVVTKKLGRSSEADLVAYAESGSLVESTTIQRSSSDSGLTELSKLGAAKKAGKTKRNRLYRTEIALAFILLAASVRSLLSAQGIHFYFLLFQGITFVIVGLDLIGEQVS

SEQ ID NO: 21027 - protein, 406 aa, Xanthomonas campestris pv. campestris str. ATCC 33913
MTDYPSRIPYARALEILHAVAANNRLPDENIATSRADGRISAADLIAPLSLPPFANSSMDGFAVRHADTLGEDVRLQLVGEQFAGDSWNGTLTAGHCLRITTGAPLPAGADTVVPKEDADEQAGLVHLRTHPTLGAAVRLAGSDVRAGDLVIQPGQVLTPARIGLAAALGVSRLAVAPRPTIAVLATGDELVEPGMPLGPGQIYNSNRDMLMAQLRALGYAPTAWPTLPDDPQRIRTMLEDAAAAFDVVITCGGVSAGEKDYLPRLIQELGQIHFWRVRMRPGMPAVLGQIGRCLVLGLPGNPVSVLATLIAYGVPLLDALQSRSEPRPVWHAALSAPWDKSHERLEFLRGRLDCGADGRLVATPHRGDASHLLRGAADSNVLIVLPEPARHYEAGEVVRVIPYAL

SEQ ID NO: 21028 - protein, 344 aa, Zea mays
MEAEKKAPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVVVVAAGVGICTVTDVEVNAKGFICACVAVFCTSLQQITIGSFQKKYNIGSFELLSKTAPIQAISLIILGPFVDYYLNGRSLLNYPFSGGATFFILLSCSLAVFCNMSQYLCIGRFSATSFQVLGHMKTVCVLILGWILFDSALTVKNILGMLLAVMGMVVYSWAMEAEKKAAAPVPRIKSEMLDGEDVPLKARVSGVPAVDLEDGEMKS

SEQ ID NO: 21029 - protein, 71 aa, Glycine max
GSPGYCMYGSSCTFVLSTENGVNGFTLDPSLGEFILTHPNIKIPSKGKIYFVNEGNARNWDEPTVSMGDSL

SEQ ID NO: 21030 - protein, 432 aa, Bacteroides thetaiotaomicron VPI-5482
MKQIVGLVLILCCTQMVAQEVFPDGKAIPEWFRENKEVNVNALGKKYSITDYGVANDSTVVQTKKIQEVIDLAARNGGGVIVIPKGTFLSGSLFFKNNTHLHLEEDAVLKGSDDISHFPVKMTRMEGQTLKYFMALVNADGLDGFTISGKGTLNGNGLRYWKSFWLRRSINPDCTNMEEMRPRIIYLSNCKNTQIEGIRIMNSPFWSTHFYKCSFLKLLNLRITSPASPVKAPSTDAVDLDVCNNVLIKNCYMSVNDDAVALKGGKGPWADKDANNGENYDIIIEDCTYGFCHSAFTCGSESILSRNVIVRRCKVDRARALLTLKMRSDTPQKYEYILVEDITGNVQNCLNIAPWTQFYDLKDRKDTPLSYSNNITMRNIDIDCNVFFNVKKSDQYKLSDFCFENLTVRAKKGKVDQSVIDSFTMNNVKINQ

SEQ ID NO: 21031 - protein, 486 aa, Saccharomyces cerevisiae
MVHLGPKKPQARKGSMADVPKELMQQIEIFEKIFTVPTETLQAVTKHFISELEKGLSKKGVNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQISKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 21032 - protein, 491 aa, Xanthomonas campestris pv. campestris str. ATCC 33913
MRSDPTHPGVPMKTGLVAGWKARFYSVCMLMLFSALVVGGLGNAQAQSGAQVTPLPTEPVTTEPLPTAQPAAAPVAAAEAAPVVEKGDVAWMLTSTLLVLLMVVPGLALFYGGMVRAKNVLSVLIQVAVVFSLLVVLWVFYGYSLAFSGEGPWIGNLDKALLKGVTIETLSATFTKGVSLPEYVFVAFQATFAGITGALIVGAFAERAKFAAVLLFSVIWFTFGYLPLAHMVWATGGYLFGLGALDFAGGTVVHINAGVAGLVGAYFVGKRAGLGREAIKPHNVTLTFVGASLLWVGWFGFNAGSNLEANAGAALAFLNTLLATAAAVLGWSLTEKIIKGKSSALGVASGMVAGLVGITPACGTVGPFGAIIIGLAAGVLCVWGVTGLKRLLGADDSLDVFGVHGLGGIIGAILTGVFSAASLGGQKGGDYDMLHQVGIQALGVGITVGWIGVVSVVGFVVAKLVFGLRVTEEAEREGLDITSHGEAAYES

SEQ ID NO: 21033 - protein, 509 aa, Zea mays
  unsure (1)..(509): unsure at all Xaa locations
MATANGSSKGSFEVPKVEVRFTKLFIDGKFVDAVSGKTFETRDPRTGEVIASIAEGDKADVDLAVKAAREAFDNGPWPRMTGYERGRILHRFADLIDGHVEELAALDTVDAGKLFAVGKARDIPGAAHLLRYYAGAADKVHGATLKMAQRMHGYTLKEPVGXVVGHIVPWNYPTTMFFFKVGPALAGXGAPVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKRXEGATLVTGGKXPCGDNKGYYIEPTIFTDVKDDMTIAQDEIFGPVMALMKFKTVEEVIQKANNTXRYGLAAGIVTKNIDVANTVSRSIRAGAIWINCYFAFDPXDAPFGGYKMSGFGKDMGMDALDKYLQTKTVVTPLYNTPWL

SEQ ID NO: 21034 - protein, 428 aa, Arabidopsis thaliana
MMTSRSIVPQQSTDDVVVVDGKNVAKGRNRQVLGDIGNVVRGNYPKNNEPEKINHRPRTRSQNPTLLVEDNLKKPVVKRNAVPKPKKVAGKPKVVDVIEISSDSDEELGLVAAREKKATKKKATTYTSVLTARSKAACGLEKKQKEKIVDIDSADVENDLAAVEYVEDIYSFYKSVESEWRPRDYMASQPDINEKMRLILVEWLIDVHVRFELNPETFYLTVNILDRFLSVKPVPRKELQLVGLSALLMSAKYEEIWPPQVEDLVDIADHAYSHKQILVMEKTILSTLEWYLTVPTHYVFLARFIKASIADEKMENMVHYLAELGVMHYDTMIMFSPSMVAASAIYAARSSLRQVPIWTSTLKHHTGYSETQLMDCAKLLAYQQWKQQEEGSESSTKGALRKKYSKDERFAVALIPPAKALLTGTESA

SEQ ID NO: 21035 - protein, 246 aa, Pinus banksiana
YTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLLLEQAAPLLCAGVTVFSPMKHFGMTEPGKKCGILGLGGVGHMGVKIAKAFGLHVTVISSSDKKKEEAMEVLGADAYLVSKDTEKMMEAAESLDYIMDTIPVAHPLEPYLALLKTNGK

SEQ ID NO: 21036 - protein, 354 aa, Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 21037 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMIKDRAAPANRQKPVDAVFNRNGKAVKLKECKVKPEVIVIIPDSEKEKKGKFPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPQWTDILEHHTGLAEPQLLDCARRLISFHALAPESKQKAVYRKYSKPKLGSVALQSPDKKLLSG

SEQ ID NO: 21038 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 21039 - protein, 210 aa, Serratia marcescens
MKKFLIAPSILSADFARLGEDTANVLAAGGDVVHFDVMDNHYVPNLTIGPMVCEALRNYGITAPIDVHLMVKPVDRIVPDFAKAGASYISFHPEASEHVDRTIQLIKEHGCKAGLVFNPATPLSYLDYVMDKIDVILLMSVNPGFGGQSFIHGTLDKLRQVRKLIDDSGRDIRLEVDGGVKVDNIAEIAAAGADMFVAGSAIFGQPDYRK

SEQ ID NO: 21040 - protein, 128 aa, Prochlorococcus marinus subsp. pastoris str. CCMP1378
MDFIKIFEKKIDIDNDLSNRYIKLDPNGYFIIKIDLETKKIILEHYLNTINKEGYAIDPKTNEPIKCDSKEIKTCNETFTGISAKEIGIAITEKRNDLISRFDHALYLGRELQKAEECLYKKLPYIQD

SEQ ID NO: 21041 - protein, 209 aa, Triticum aestivum
  unsure (1)..(209): unsure at all Xaa locations
MAEPLKTNGNGAAEAGSAFASVKVPPSPPRRLQRFDSLHMEAGKIPGGHSYAAKVGWATTLHLAFQSLGVVYGDMGTSPLYVFSXSTFTGGIKDTDDLLGVMSLIIYTVLLLPLMKYCFIVLRANDNGDGGTFALYSLISRYARIXLIPNQQAEDATVSYYKLESXTIVSSGSLVKEKWKQPEFKYFSRTIQHGGTGATFVRGISIKSY

SEQ ID NO: 21042 - protein, 316 aa, Triticum aestivum
  unsure (1)..(316): unsure at all Xaa locations
MEPAEKKPPAVSDLGAWGMNVVSSVGLIMANKQLMSSAGYAFSFATTLTGFHFTVTALVGWISKATGYSASKHVPLWELVWFSLVANASITGMNLSLMLNSVGFYQISKLSMIPVVCLMEWVLNSKXCACLAVFCTSRQRITIGSFQKKYNIGSFELVSKTAPIQAVSLIILGPFVDYYLNGRWLLNYSFSTGATFFILLSCSLAVFCNMSQYLCIGRFSATSFQVLGHMKTVCVLILGWVLFDSALTIKNILGMLLAIMGMVVYSWAMAVXRRRPPRPIPRNKSDMLDGEDVPLKSRTSGIPLSSDDLEEGPMKS

SEQ ID NO: 21043 - protein, 634 aa, Xylella fastidiosa Temecula1
MSTSSHSGDCAAITSNSNSTIILSAIGVVFGDIGTSPLYTLKEAFSPNYGLAPNHDTVLGILSLIFWAMMLVVTIKYVTVIMRVDNDGEGGIMALTALTQRTMPFGSRSIYIVGILGIFGTSLFFGDGIITPAISVLSAVEGLEVAEPHMKAFVVPITLAVLILLFLCQRFGTERVGKTFGPITFLWFIAIGVVGVYNIIQAPEVLYAINPWWGLHFFLEHGWHSMFVLGAVVLAVTGGEALYADMGHFGAKAIRHAWMYVVLPMLALNYLGQGALVLSNPTAIGNPFYQSIPDWGLYPMIALATAAAVIASQALITGSYSLSSQAMQLGYIPRMNVRHTSQSTIGQIYVPTVNWTLLMLVILTVIGFGDSTSMASAYGVAVTGTMMITTVLMIIYARANPRVPRLMLLMIAIVFIAVDGAFFYANIIKFMDGAWFPLLLGVVIFTFMRTWLRGRKLLHEEMRKDGINLDNFLPGLMLAPPVKVPGTAVFLTADSTVVPHALMHNLKHNKVLHERNVFLTVKTLKIPYAANSERLKIEPISNGFYRVHIRFGFMETPDVPSALMCSKDHAGIDFDPMHTTFFVSRETVIPSANRGMPIWRDKLFVLMHRNAAPANAFFRIPGNRLVELGTQVEI

SEQ ID NO: 21044 - protein, 482 aa, Photobacterium profundum
MNLNDPSLFKQKCYIAGQWVTAENGKVEPVTNPSTGEIIGYVPVMGQEETLHAIEVAQQAFLSWKKVSAKERSNTLRKWYELILENVDDLATIMTTEQGKPFAEAKGEVVYAANFIEWFAEEAKRTYGEVIPSHKTDARIVVSKEPIGVVGAITPWNFPAAMITRKCGPAFAAGCAVVLKPAPDTPFSAFALAELAERAGLPSGLFNVITGDAVAIGGELTKNKVVKKISFTGSTAVGKLLMAQSAPTVKKLSLELGGNAPFIVFEDADLDAAIDGVMVAKFRNAGQTCVCANRLYVHETVYDVFVEKLVQRVSTLIMADGFTDGATIGPLINRASAEKVQSHVTDALDKGATLAFGEKADPATNFFPPHVITHVTDEMRVATEETFGPLAAVFSFATEDEVIARANDTDSGLASYVYTRSLQRAWRMGESLEFGMVGINEGLISTEVAPFGGVKESGLGREGARQGICDYMETKYMLMGGL

SEQ ID NO: 21045 - protein, 415 aa, Osmundea pinnatifida
EASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGLVVERERMDKFGRPFLGATVKPKLGLSGKNYGGVVYEGLKGGLDFLKDDENINSQPFMRWKERFLYSMEAVNRSIAGTGEVKGHYMNITAATMEEMYERAEFAKQIGTVIIMIDLVIGYTAIQTMAIWSRKNDMILHLHRAGNSTYSRQKIHGMNFRVICKWMRMAGVDHIHAGTVVGKLEGDPLMIKGFYDTLLEPYLKQNLSQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITF

SEQ ID NO: 21046 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 21047 - protein, 511 aa, Burkholderia fungorum
MRNTQFTQISRSFVVNIPDASVWRARAQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWIAG

SEQ ID NO: 21048 - protein, 291 aa, Arabidopsis thaliana
  unsure (1)..(291): unsure at all Xaa locations
MASKSKQHLRYQPRKSVSRSTQAFTVLILLLVVILILLGLGILSLPNANRNSSKTNDLTNIVRKSETSSGDEEGNGERWVEVISWEPRAVVYHNFLTNEECEHLISLAKPSMVKSTVVDEKTGGSKDSRVRTSSGTFLRRGHDEVVEVIEKRISDFTFIPVENGEGLQVLHYQVGQKYEPHYDYFLDEFNTKNGGQRIATVLMYLSDVDDGGETVFPAARGNISAVPWWNELSKCGKEGLSVLPKXRDALLFWNMRPDASLDPSSLHGGCPVVKGNKWSSTKWFHVHEFKV

SEQ ID NO: 21049 - protein, 316 aa, Clostridium thermocellum ATCC 27405
MLEIMFFSDKIEIVNELFKRMKRGVNILRVRKAIIPAAGLGTRFLPATKAQPKEMLPIVDKPTIQYIVEEAIKSGIEDIIIISGRSKRAIEDHFDKSYELEQELEKKGNHDLLKLVQDISNLANIHYIRQKEAKGLGHAIYCAKSFIGNEPFAVLLGDDIVDSEVPCIKQLMDVYDKYRTTVLGVQKVPEDQVSKYGIVGGEIVSDRVYKVKDLVEKPDTASAPSNIAILGRYIITPRIFDYLENAKPGKGGEIQLTDALRELMGEEEMYAYDFIGKRYDVGNKLGFLQATVEFALARDDLKEEFEAYLKEIICKL

SEQ ID NO: 21050 - protein, 402 aa, Desulfovibrio vulgaris subsp. vulgaris (strain Hildenborough)
MNAADTAFILICAALVMLMTPGLALFYGGLVRAKNVLSTTMHSFVLVGVASVVWAIIGYTLAFGPDVAGVIGGLDHLFLKGVGMEPSEAAKTIPHLAFMVFQCMFAVITPALISGAYAERISFRAMLLFSVLWLVLVYAPMAHWVWGGGWMFKMGALDFAGGAVVHMSSAAAALAAAHVLGRREGYGREPFVPHNLPMTVLGAGILWFGWFGFNAGSALAANGLAAMAFVTTHLATAAGVMGWLAVEWMHSGKPTTLGAASGAVAGLVAITPAAGFVEPMPAMIIGFGGGMLCYGGVLMKKVFKYDDALDVVGVHGVGGTWGALATGLFASEAVNGVNGLFYGNPGQLWTQFLSVVATWLFCYLMSRGIFHAVDALMGLRVTVDAERAGLDVSEHNERAYEQ

SEQ ID NO: 21051 - protein, 394 aa, Xanthomonas campestris pv. campestris str. ATCC 33913
MDSLLSPVSGYSRRSQDIAPFHVMALLARANALEQAGHDVIHLEIGEPDFTTAAPVVAAGQAALAAGHTRYTAARGLPALREAIAGFYAQRYGCHIDPERVLVTPGGSGALLLASSLLVDPSKHWLLADPGYPCNRHFLRLVEAGAQLVPVGPDSDYQLTPALVDACWTADSVGALVASPANPTGSVLSRAQLAALSQALQARGGHLVVDEIYHGLTYGLDAHSVLEVDDSAFVLNSFSKYFGMTGWRLGWLIAPPSAVPELEKLAQNLYISASSIAQHAALACFTPESIAIFEARRAEFQQRRDYLLPALRALGFDIAVEPQGAFYLYADISAFSKDAQAFCTHFLETEHVAFTPGIDFGFHRANQHVRIAYTQSLPRLEQAVERIARGLRHI

SEQ ID NO: 21052 - protein, 311 aa, Oryza sativa
MAFHYQDHALAMDAAAAAAETGGHHHPGFVGAGGVVGGGGGGGWEREKAAIAAHPLYERLLEAHVACLRVATPVDQLPRIDAQIAARPPPLAAATAAAAAAAAGGAPSGGEELDLFMTHYVLLLCSFKEQLQQHVRVHAMEAVMACWELEQTLQSLTGASPREGSGATMSDDEDNQVDSESNMFDGNDGSDGMGFGPLMLTEGERSLVERVRQELKHELKQGYREKLVDIREEILRKRRAGKLPGDTASTLKAWWQAHSKWPYPTEEDKARLVQETGLQLKQINNWFINQRKRNWHSNPASSSSDKSKRKR

SEQ ID NO: 21053 - protein, 256 aa, Novosphingobium aromaticivorans
MSHRPYIVGNWKMNGSRAMLAEARAIDRAAGRYPDVQVAIAPPFTLIGALREAVSAMGVGGQDCHTEVKGAHTGDVSAAMLVDTGADFAILGHSERRKDHGENDALVKAKAEAALTAGLDIIVCVGETLDQRDAGKAEAVVSSQVDGSLPSPETAAEAVAAGKVAVAYEPVWAIGTGRVAAVEDVVTMHAAIRARLVALYGESGSKVRILYGGSVNSGNAAELLAADGVGGALVGGASLTAEAFLPIVAAAGTGEA

SEQ ID NO: 21054 - protein, 189 aa, Triticum aestivum
MMSSKKLAQLSKKWQGISAIGRRRVTTTDKDVHPSCSSVAGKGHFVVYSSDGRRFEIPIACLRTMIFEELLRMSQEEFGFTSEGRITLPCDTTMMEYVMCLLRREASEDVERALLSSIITTCHHPSRMMQAATGLHQQFSVRSSSRVNISRFFFLFSCSIFFPGCTFGAHLLCNVFPRVPYCGCTDGCM

SEQ ID NO: 21055 - protein, 1066 aa, ASPERGILLUS NIDULANS FGSC A4
MVAPDVPEVATARVATGRFISVFRSIPFQIAIASGVSFTAPGMWDALNNLGAGGAAEPYAVSAANALLYGLFAVVCVAAGAINNRIGLRYGLALGAIGYPIYGAGLYTNNYSPTTWFLLFGSALCGISAGFFWAAEAAIIIGYPSPQDRAFYLAIWQTAKAAGPIVGGAINLGLNAQNSGQGSVSASTYIVFIVIMCLGLPIAILLSPAHKVLRKDRTLVLVHKQASWAAEFKAAFALIASRRVVMLLPAFFISYFYNGFQSTWLTSYFTVRSRAFSSFFTNFAGIISSFLIAGLLDRQSIHIKTRARVAFAAIVLVLTGTWIWATILQYQFYYDLPESPVFDWFKGGFGKTYALVFFWTFAGQAFQQFLYWLVGQYATDLSSLSYHCGILRGFEALGQTVAWAFPDKSKVRPPTFSMPPPKTKVACKSCHSRRVRCDRTQETPCSRCRSTGQECEPIVSKRGKHKRELLRRSGFRHSFGPVPGASESGTDVTSLSTPATFASERSARESIATYTSRANTTEYKSGRTIYYGDYFNLEYTRRELDESHEDYNPRMSNTRLAHVDRLGSPTRRFVDDYFCRERARLDELGAFDTLNRNTRDKLLCTFFEMINPVVPIIDRKDFLSKLETGHVSQLLLQAMYMVSFLHSDPSIIADAGFGNRYMAAFTCYHRAKALYDAGYETDAVAVIQALLCLSFWWETPTQQKDMWYWTGISVNLAQSLGMHQEYTYLSLDQRKSKLWRRLWWTIYGHDISTAVQLGRIPHVNDAYCTTRLVTEQDFDDDDDNDDPPDRFGGNATKETRLESVYLADLCLRVSGCYRSLYTGNSDPSTALGNMKALAEWKTSLPLELQCRTTLTLHNGLFAALLNLTYFCFEIILRRNHFRNPEMMTPGTPVFEAAVEIVRVLENILTAELITACPLRLLPPTFAALSVLILNMRLPAREVNEVSKHRARLCMLVLSKLVDHWPPGLLYYRLFARILAARGCEVPDEPPPPAGINEQPTEFCPPVVEGHYSFPTTSDFLISNTMAGEAELIGVNSLFPFSAFLNEEFIENDLNPMRSANNDSLQP

SEQ ID NO: 21056 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 21057 - protein, 118 aa, Zea mays
FGNCALQIGVAAGSPEDGNALNVDVQKFIQGSLYKSAMESKKQSYLANLALYPGRSELPFLPANTQALILQPIGDKGIAIVGGDTIRGFTNIDQAWIAMIADKLDATLSKSSNAGLLI

SEQ ID NO: 21058 - protein, 189 aa, Geobacter metallireducens
MLLMIDNYDSFTYNIVQYFGELGEDVRVFRNDGITLEEIERLAPERLVISPGPCSPEEAGISVAAIRHFAGKIPILGVCLGHQSIGAAFGGKVVRSSTLMHGKTSPIHHNGQGLFRGLPNPFNATRYHSLVVERATFPDCLEITAWVEEGEVMGLAHRELPIWGVQFHPESILTEGGMDILKNFLEMTQ

SEQ ID NO: 21059 - protein, 335 aa, Hypocrea koningii
VPKVGINGFGRIGRVVLRNALETGAVEVVALNDPFIEPHYAEYMFKYDSTHGRFKGDIKVDGKDLVIDGKRIKFYQERDPANIPWKDSGAEYIVESTGVFTTTEKASAHFKGGAKKVIISAPSADAPMYVMGVNEDTYAGANVISNASCTTNCLAPLAKTLNDKFTIVEGLMTAIHAYTASQKTVDGPSSKDWRGGRAAAQNLIPSSTGAAKAVGKVIPELAGKVTGMSVRVPTVNVSLVDFTVRFAKDVTYDEVKAAIKEASEGPLKGILAYTEDDIVSTDILTDPHSSTFDAKAGIALNKNFVKVMSWYDNEYGYSRRVVDLIVYVSKKDAGQ

SEQ ID NO: 21060 - protein, 483 aa, Nicotiana tabacum
MGFISSIDNELLSKVATNNGHGENSAYFDGWKAYEIDPFHPTQNSDGVIQMGLAENQLCFDLIQEWVVKNPKASICTAEGSQDFKDIAIYQDYHGLPEFRSAVARFMGKVRGDRITFEPERIVMSGGATGAHELLAFCLADPGEAFLVPTPYYPGFDRDLRWRTGVQLFPVVCESSNNFKVTKEALEAAYQKAQESNITVKGLLLNNPSNPLGTILDRETLKDTVRFINEKNIHLVCDEIYAATIFNKPDFISISEVIMEEDVECDRDLIHIVYSLSKDLGFPGFRVGIIYSYNDVVTNCARKMSSFGLVSTQTQFLISNMLSDENFVTKFIGESSERLQKRHGMFTRGLAQVGINTLKSNAGLFIWMDLRRLLKELTFEAELELWRIIINEVKLNVSPGCSFHCSEPGWFRVCFANMDDETMRIALRRINNFVIQRKGIEGGVKKLQCRRSKLEISLSFRKLDDFMNSPHSPMSSPLVQART

SEQ ID NO: 21061 - protein, 492 aa, Zantedeschia aethiopica
MDPCKYRPSSSYDASFTTTNAGGPVWNDDVALTVGSRGPILLEDYHLIEKVAHFARERIPERVVHARGASAKGFFECTHDVTHLTFADFLRAPGVQTPVIVRFSTVIHERGSPETIRDPRGFAVKFYTREGNWDLLGNNFPVFFIRDGIKFPDVIHAFKPNPKSNVQEYWRVLDFLSHLPESLHTFCFLYDDVGVPLNYRHMEGFGVNTYTFINKAGKTNYVKFHWKPTCGVKCMLEDEAVVVGGKNHSHATQDLYDSIAAGNYPEWKLFVQVMDPDEEDKYDFDPLDDTKTWPEDLLPLQPVGRLVLNRNIDNFFNENEQLAFSPGIIVPGIYYSDDKMLQCRTFAYGDTQRYRLGPNYLMLPVNAPKCAHKNSHYDGLMNFMHRDEEVNYYPSRHDRLRNAERFPINNRPIIGKREKCTIEKQNDFKQPGERYRSWAPDRQERFVRRWVEALAHPKVTFEIRTIWVSYLSKCDASLGQKVANRLNMKPSM

SEQ ID NO: 21062 - protein, 351 aa, Arabidopsis thaliana
LKALILVGGFGTRLRPLTLSMPKPLVDFGNKPMILHQIEALKGAGVTEVVLAINHQQPEVMLNFVKEYEKKLEIKITFSQETEPLGTAGPLALARDKLVDESGQPFFVLNSDVICEYPLLEMIEFHKTNRAEASIMVTEVDDPSKYGVVVTEEGTARVESFVEKPKHFVGNKINAGIYLLSPSVLDRIELRRTSIEKEIFPKIASEKKLYAMVLPGFWMDIGQPKDYITGQRMYLNSLREKTPQELATGDNIIGNVLVHESAVIGEGCLIGPDVVIGPGCVIDSGVRLFGCTVMRGVWIKEHACISNSIVGWDSTVGRWARVFNITVLGKDVNVADAEVYNSGVVIEEQGL

SEQ ID NO: 21063 - protein, 376 aa, Triticum aestivum
  unsure (1)..(376): unsure at all Xaa locations
GIRSCAPDTKPIGTAAFVSRASFGRVSTDLAMECLAEMPHAPLDRRPRKRQRLGWDVGPEIPQLKKLCGEEVANVISAMTMGLSSGGIVFSQETQGLFRFATPPLREDDKDGHYVFAVGDNLTSRYRINAKMGEGTFGQVLECWDRERKEMVAIKIIRGIKKYRDAAMIEIGMLEQLCKYEKSRSRXSSRSPKEGSYYKRVPKSSSIKVIDFGSTTYDQQDQTYVVSTRHYRAPEVILGLGWSYPCDIWSVGCILVELCTGEALFQTHENLEHLAMMERVLGPLPYHMLKKADRHGEKYVRKGRLNWPEGCASRESMKAVMKLPRLQNLVMQNVEHSAGDFINLLQGLLSYDPASRLTAQEALEHPFLTERSERRR

SEQ ID NO: 21064 - protein, 339 aa, Mucor racemosus
MSTINTGINGFRSHWPYCLACSLENPKVKVVAINDPFIDLEYMVYMFKYDSTHGRFKGTVEHKDGKLVVNGHEIAVHAERDPAQIPWGSHGADYVIESTGVFTTKDAASAHLKGGAKKVIISAPSADAPMFVVGVNLDKYTSDLTVISNASCTTNCLAPLAKVIHDNYGILEGLMTTVHATTATQKTVDGPSNKDWRGGRGAGANIIPSSTGAAKAVGKVIPELNGKLTGMAFRVPTPDVSVVDLTVRLEKPASYDEIKATIKKASESEELKGILGYTEDQVVSTDFVGDAHSSIFDAKAGIQLSPTFVKLISWYDNEFGYSTRVVDLLAYVAGKDGAL

SEQ ID NO: 21065 - protein, 439 aa, Glycine max
MKFTPSSKFLGFSNHFHSLLAPSFSPTPKFSSSFSATMSTLSTQNDTVTHKTQQPLQIAKRLEKFQTTIFTQMSLLAIKHGAINLGQGFPNFDGPEFVKEAAIQAIRDGKNQYARGYGVPDLNIAIAERFKKDTGLVVDPEKEITVTSGCTEAIAATMIGLINPGDEVIMFAPFYDSYEATLSMAGAKVKGITLRPPDFAVPLEELKSTISKNTRAILINTPHNPTGKMFTREELNCIASLCIENDVLVFTDEVYDKLAFDMEHISMASLPGMFERTVTLNSLGKTFSLTGWKIGWAIAPPHLSWGVRQAHAFLTFATAHPFQCAAAAALRAPDSYYVELKRDYMAKRAILIEGLKAVGFKVFPSSGTYFVVVDHTPFGLENDVAFCEYLVKEVGVVAIPTSVFYLNPEEGKNLVRFTFCKDEETIRSAVERMKAKLRK

SEQ ID NO: 21066 - protein, 600 aa, Streptomyces coelicolor A3(2)
MTQVADYVLQRLSEWGVQRVYGYPGDGINGLLGAFDRADGDPEFIQARHEEMAAFMACGHAKFTGEVGCCVATSGPGAVHLLNGLYDAKLDHQPVVAVVGQQKRLSLGTHYQQEIALDQLFADVSEYCQMVVHPGQARHVVDRAFKTALTTRGVATIIIPNDIQEEEAQPSPPREHGSVFSSVGWSRPRVLPDLDELRKAADVLNAGNKVAMLVGQGAANAEAEVKEVAELLGAGVAKALLGRQVLPDDLPYVTGPIGLLGSKASDNMIQGCDTLLMVGSSFPYSEWLPEEGQARGVEIDIDGRMIGIRYPMDAHLVGDSRETLRALIPMLQRKKDRGWREKIEKDVREWHDLCDRWAGEHFGKTINPQAVAAELSARLPDDVILTADSGSGTNWWARHLLLRDGMQASLSGTLATMGPGTPYAIAARFAYPERPVIAFIGDGAFQMNGMNEMITVKRYLDRLSGSAPLIFCVFNNQDLNQVTWEQRAMAGDPKYPGSQDIPDVPYAAYAELLGLKGIVCDDPKKVGAAWDEALSAGRPVVLEFKVDAEIAPIPPHIMKEQGKKAIKAALHDPEATGIATKGVRQKLTEYAEHLPGRGRK

SEQ ID NO: 21067 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 21068 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 21069 - protein, 376 aa, Oryza sativa
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 21070 - protein, 282 aa, Glycine max
  unsure (1)..(282): unsure at all Xaa locations
MDHSADAHRTDLMTITRFVLNEQSKHPESRGDFTILLSHIVLGCKFVCSAVSKAGLAKLIGLAGETKEQAGGQSFXARNGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 21071 - protein, 280 aa, Glycine max
MDCFCCFNNQVVGGRTSCGSGKGKSHQGSVKYGFSLVKGKANHPMEDYHVAKIVKLGGQELGLFAIYDGHLGDSVPAYLQKHLFSNILKEEDFWTDPASSIIKAYETTDQAILSDSSDLGRGGSTAVTAILIDNQKLWVANVGDSRAVLSRKGVAEQMTIDHEPNTERGIIENKGGFVSNMPGDVARVNGQLAVSRAFGDKNLKSHLRSDPDIRHVDIDPDAELLILASDGLWKVMANQEAVDIARRIKDPQKAAKQLVAESLNRESKDDISCIVVHFKG

SEQ ID NO: 21072 - protein, 178 aa, Zea mays
SRPAGPGFGNWNVHIRATSDPEIWKKGPAFGMPGVHVDGMDVLKVREVAKEAIERARRGEGPTLVECETYRFRGHSLADPDELRKPDEKTHYAARDSITALKKYIIEQNLATESELKSIEKKIDDVVEEAVEFADASPHPPRSQLLENVFADPKGFGIGPDGKYRCEDPKFTQGTAQV

SEQ ID NO: 21073 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 21074 - protein, 244 aa, Glycine max
PSSSLESSTAMTTATEKLSALKSAVAGLNEISESEKNGFISLVSRYLSGEAQHVEWSKIQTPTDEVVVPYDTLAPTPDGSSDVKNLLDKLVVLKLNGGLGTTMGCTGPKSVIEVRDGLTFLDLIVIQIENLNSKYGSNVPLLLMNSFNTHDDTQKIVEKYQNSNIEIHTFNQSQYPRLVAEDFLPLPSKGHTDKDGWYPPGHGDVFPSLLNSGKLDALLSQGKEYVFVANSDNLGAIVDLSILI

SEQ ID NO: 21075 - protein, 495 aa, Neurospora crassa
MEVELTAPNGKKWMQPLGLFINNEFVKSANEQKLISINPTTEEEICSVYAATAEDVDAAVSAARKAFRHESWKSLSGTERGALMRKLADLVAENAEILATIECLDNGKPYQTALNENVPEVINVLRYYAGYADKNFGQVIDVGPAKFAYTVKEPLGVCGQIIPWNYPLDMAAWKLGPALCCGNTVVLKLAEQTPLSVLYLAKLIKEAGFPPGVINIINGHGREAGAALVQHPQVDKIAFTGSTTTGKEIMKMASYTMKNITLETGGKSPLIVFEDADLELAATWSHIGIMSNQGQICTATSRILVHEKIYDEFVEKFKAKVQEVSVLGDPFEESTFHGPQVTKAQYERVLGYINVGKEEGATVMMGGEPAPQNGKGFFVAPTVFTNVKPTMKIFREEIFGPCVAITTFKTEEEALTLANDSMYGLGAALFTKDLTRAHRVAREIEAGMVWVNSSNDSDFRIPFGGVKQSGIGRELGEAGLAPYCNVKSIHVNLAA

SEQ ID NO: 21076 - protein, 897 aa, Glycine max
MDCNGAAEEVTGKLKELVMIHLQRPELFCKGQLSNPCKVILLFGPHVSGERNGTLDMQAASTLDSSVRCAVFKAYVYAAILDGKEIDVSFDNFPYYLSENTKNVLVAACFMHLRHKEHEKFTADLTTINPRILLSGPAGSEIYQEMLVKALAKYFGAKLLIFDSHLLLGGLSSKEAELLKDGLNAEKSFGCTKLSPTEIMARIMDPLASEIETPSPSNAPTSYGFESQPKLETDNMPSTSGTAKSCSFKLGDRVKFSCSSSCGVYQTSPRGPSNGSRGKVVLLFDDNPLSKIGVRFDKPIPDGVDLGGACEGGQGFFCNVTDLRLESSAVEELDKLLIHSLFEVVFSESRSAPFILFMKDAEKSIVGNGDSHSFKSKLENLPDNVVVIGSHTQNDSRKEKSHPGGLLFTKFGSNQTALLDLAFPDSFGRLHDRGKEAPKQNRTLTKLFPNKITIHMPQDEALLASWKQQLDRDVETLKIKGNLHHLRTVLGRCGMECEGLETLCIKDQTLTNENAEKIIGWALSHHLMQNSEAKPDSKLVLSCESILYGIGILQSIQNESKSLKKSLKDVVTENEFEKRLLADVIPPSDIDVTFDDIGALEKVKDTLKELVMLPLQRPELFCKGQLTKPCKGILLFGPPGTGKTMLAKAIATEAGANFINISMSSITSKWFGEGEKYVKAVFSLASKISPSVIFVDEVDSMLGRRENPGEHEAMRKMKNEFMVNWDGLRTKETERVLVLAATNRPFDLDEAVIRRMPRRLMVNLPDAPNRAKILKVILAKEELSPDVDLDAVASMTDGYSGSDLKNLCVTAAHRPIKEILEKEKKERAAALAEGQPAPALCSSGDVRSLNMEDFKYAHQQVCASVSSESVNMTELLQWNELYGEGGSRVKKALSYFM

SEQ ID NO: 21077 - protein, 447 aa, Triticum aestivum
MSTRSRSVQGSVGGGGSTAGGSAVPLAVLLRREVVSERTAAERPELQHGLFSQAKKGEDFVFLKPDCERLPGFPSSSFSAFGLFDGHNGNGAAIYTKENLLNNILGAVPADLNREDWLAALPRAMVAAFVKTDKDFQTVARSSGTTVTFVIIDGLVVTVASVGDSRCVLEAEGSIYQLSSDHRFDASKVEVDRVTEAGGDVGRLNVVGGAEIGPLRCWPGGLCLSRTIGDQDVGEFIVPVPLVKQVKLSTAGGRLIISSDGVWDALTAEQALNCSRGLPPEAAAEQIVKDAVHSKGLRDDTTCIVVDLVPEKGNPAMSAPKKQPGMGVFKNMFRKKTSSDSSSHADREYMDPDVVEEIFEDECALLSRRLDSEYPVRNMFKLFICAICQVELKPNQGISVHEDSSQPGNLRRWDGPFLCQSCQEKKEAMEGKRRSRDSSSRNSGSSE

SEQ ID NO: 21078 - protein, 305 aa, Saccharomyces castellii
MSTEKPQSNFAIDFLMGGVSAAVAKTAASPIERVKLLIQNQNEMLKQGTLDTKYKGIVDCFRRTAQQEGIISFWRGNTANVIRYFPTQALNFAFKDKIKLMFGFKKEDGYGKWFAGNLASGGAAGGLSLLFVYSLDFARTRLAADSKSSKKGGSRQFNGLIDVYKKTLKSDGVAGLYRGFLPSVVGIIVYRGLYFGLYDSIKPVLLTGSLEGSFLASFLLGWVVTTGASTCSYPLDTVRRKMMMTSGQAVKYKGAFDCFKKIVAAEGVASLFKGCGANILRGVAGAGVISMYDQLQMILFGKKFK

SEQ ID NO: 21079 - protein, 479 aa, Microbulbifer degradans 2-40
MLCSCAHYCIWCKQIVQTGANIRSIANRADGRNIFKKYNNISSKEVPLMKPLLRTLPLAALLLPSIALADDLNGANTAWILTATALVLFMTLPGLSLFYGGLVRTKNVLSVLMQCFAIACIASLIWFAFGYSLAFSEGNMIIGDLSKAFFNGMGKNSMSGDIPEPLFAMFQMTFVIITPALIVGAFAERMKFSSVLISTVLWIPLVYAPVCHWVWGGGWLASQFGVLDFAGGTVVHITAGVAALVTALMIGNRNGFPHTPMPPHNMTMTVTGAGMLWVGWFGFNAGSALSAGGDAAMAMLVTHISAAAGSLAWMTIEWLKFGKPSVLGIVTGMVAGLGTITPASGFVGPGGALVIGITAGVVCFYATQLIKRKLVIDDSLDVFPVHGVGGILGTMLAGVFASTSIGAFSGHGFADGIETMGAQVWSQFVGVITTIVFTAVMTYIIIKVTGWITGGIRVDKDEETQGLDLVLHDEAGYKL

SEQ ID NO: 21080 - protein, 472 aa, Hordeum vulgare subsp. vulgare
MTYGGERRGSNPTTVIHKTFLPLPLFRVLETTSSSCSSPSFPRPYFSPPVHSAAGEDFRRRAREAIGIDPWMDAAQWHQGLGLVKPMEEMIMAGNPNPNPNGNPSPQPAPPSGAEAQRAPLPGPPAAGAGAAAGTGSTERKAARPQKEKAINCPRCNSTNTKFCYYNNYSLQQPRYFCKTCRRYWTEGGSLRNVPVGGGSRKNKRSSSSVVSSAAGAVSTSGAASGTVPVGGMPAKNPKLMHEGAHDLNLAFPHHHGRVLHPSEFAAFPSLESSSVCNPGGAMAANGVGGGRGMGTFSAMELLRSTGCYVPLPQVQLGMPPEYAAAGFALGEFRMPLQHQQQHHQQQQQQQQQHHQHQHQHQQHQQQQQQQQVQNMLGFSLDTGGGGDGGGYGGGLQGAQESATGRMLFPFEDLKPGANAAGGGGASGGDQFEHSKEQGGGGGHETLGFWNNSMIGNGSSNDAGGGGGGGSW

SEQ ID NO: 21081 - protein, 363 aa, Pichia jadinii
MPEKTIVVLPGDHVGTEITAEAIKVLKAIEEVKPEIKFNFQHHLIGGAAIDATGVPLPDDALEASKKADAVLLGAVGGPKWGTGAVRPEQGLLKIRKELNLYANLRPCNFASESLLDLSPIKAEVVKGTDFVVVRELVGGIYFGERKEDDGSGVASDTETYSVPEVQRITRMAAFMALQHNPPLPIWSLDKANVLASSRLWRKVVTETIEKEFPQLTVQHQLIDSAAMILIKYPTQLNGIVITSNMFGDIISDEASVIPGSLGLLPSASLASLPDSNKAFGLYEPCHGSAPDLPANKVNPIATILSAAMMLKLSLDLYEEGVAVETAVKQVLDAGIRTGDLKGTNSTTEVGDAVAEAVKKILA

SEQ ID NO: 21082 - protein, 1230 aa, Cryptococcus neoformans var. grubii
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 21083 - protein, 488 aa, Porphyra pseudolinearis
MSQSVESRTRIKSERYESGVIPYAKMGYWDADYVIKETDILALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERFLYSMEGVNKASASAGEIKGHYLNVTAATMEDMYERAEFSKDVGSIICMIDLVIGYTAIQSMAIWARKHDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRNYVAEGPQILRDAAKTCGPLQTALDLWKDISFNYTSTDTADFVETPTANI

SEQ ID NO: 21084 - protein, 177 aa, Triticum aestivum
  unsure (1)..(177): unsure at all Xaa locations
MASSATSVAPFQGLKSTAGLPVSRRSNGASLGSVSNGGRIRCMQVWPIEGIKKFETLSYLPPLSTEALLKQVDYLIRSKVGALASKFNKVGFIFREXHNASPGVLRIGRVLDNVESCPMFRVATDATQVINEVEEVKKXEYPDAYVRIXIGFDNMRQVQCVSFIAFKPPGCEESGKA

SEQ ID NO: 21085 - protein, 437 aa, Eremothecium gossypii
MGQGASTYGKGQKGKKDKKQKPKYEPPVQSKIGRKKRKGPATAEKLPNVYPSTRCKLKLLRMERIKDHLLLEEEFVTNSEILKPFEMKQEEERKQLEEIRGTPLSIGTLEEIIDDDHAIVTSPTTPDFYVSILSFVDKELLEPGCSVLLHHKTMSIVGVLQDDADPMVSVMKIDKSPTESYNDIGGLEAQIQEIKEAVELPLTHPELYEEMGIKPPKGVILYGAPGTGKTLLAKAVANQTSATFLRIVGSELIQKYLGDGPRLCRQIFKVAAENAPSIVFIDEIDAIGTKRYDSNSGGEREIQRTMLELLNQLDGFDDRGDVKVIMATNKIESLDPALIRPGRIDRKILFENPDVSTKRKILGIHTSKMNLSADVDLETLVTSKDDLSGADIKAMCTEAGLLALRERRMQVTVEDFKQAKERVMKNKVEENLEGLYL

SEQ ID NO: 21086 - protein, 167 aa, Listeria monocytogenes
ARGAGAHGKFVTKKSMKKYTMAKFLQEEGTETEVFARFSTVIHGQHSPETLRDPRGFSVKFYTEEGNYDFVGNNLPVFFIRDAIKFPDVIHSLKPDPRTNIQDGNRYWDFFSLTPEATTMITYLFSDEGTPASYREIRGSSVHAFKWINEAGKTVYVKLRWVPKAGI

SEQ ID NO: 21087 - protein, 463 aa, Methanocaldococcus jannaschii
  unsure (1)..(463): unsure at all Xaa locations
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIXTIIISK

SEQ ID NO: 21088 - protein, 216 aa, Triticum aestivum
NEHDIPSERLLFKIPATWPARPPSRPLESEGTQTHLTFVYSFAQAAAAAQAGASVVQIFVGRIRDWAKNHSGDPEIDEALKKGEDAGLALVKKAYVYIHKNGYKTKLMAAAVRNKQDVFSLLGIDYIIAPLKILQSLDESVTDSDEKYGYVQRLTLSLDKMYNFSQEELVKWDQLSLAAAMGPAAEELLASGLEGYANQARRVEELFAKIWPPPNV

SEQ ID NO: 21089 - protein, 664 aa, ASPERGILLUS NIDULANS FGSC A4
MSKFRARLYKTDRARDFEHEQDRHVRTRQIYETIDRQSFQWIVVLVAGVGFFLDGYTLFASNIALPMISYVYWREDTSSFRLTCINIATLSGTLLGQVLFGYLADRNGRKKMYGVELALLIASTLGVAMSSEGTHGSMSVFAWLIWWRIIVGIGVGADYPLSAVITSEFAPTRHRARMIASVFFMQPLGQIAGNIVSLIVAVLSKKQGHDDVTRAVDIMWRWVVGIGVVPGVIATFFRFFIPESPRFLLEIEDDPVQAEFDATTLFSDPAPLSSLGSPEIAVEEGYRYPGSASTALTSMTTATANQFNDINLIAPWNEIILPAPALPATATTMGTGKGTSTAAGPDTAGTGAGALTIRSMSIDDFTDRTPSQYHDSLPEGTFLTPATLNSHWRLTKVDITQYFWHEGNWRTLLATSLSWLLLDFGFYGIGLSSPQFLAKTWDSLKLSGPAPPWMTDDTGATDIYDMFRDTSIHCLIILNIGSFVGGVLMLLTIHKLERVSLQKYGFLALAAHFIALGTMFITVHKEGPVAVTLYIIGQILFNFGPNTTTYMIPAEIFPTRYRATCHGISAGAGKLGSILIQLLSAYYKFGTGPGNEQTVRHGYMLIVFSACMVIGAAVTHFWIPPTQRKSSDGRAKLWGGKAETLETLGLGRRGWKSRFAGVRR

SEQ ID NO: 21090 - protein, 299 aa, Triticum aestivum
VVVDWGAAYLAPLLQFLTDACVVLFLIQSADRLIQCLGSFYITVKRIKPRLKSPALPDAEDPDAGYYPMVLVQIPMCNEKEVYQQSIAAVCNLDWPRSNFLVQVLDDSDDPTTQSLIREEVAKWQQTGARILYRHRVLRDGYKAGNLKSAMACSYVKDYEFVAIFDADFQPNPDFLKRTVPHFKDNDELGLVQARWSFVNKDENLLTRLQNINLCFHFEVEQQVNGVFLNFFGFNGTAGVWRIKALEESGGWMERTTVEDMDIAVRAHLHGWKFIFLNDVECQCELPESYEAYRKQQHR

SEQ ID NO: 21091 - protein, 268 aa, Lycopersicon esculentum
WKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTATQKTVDGPSMKDWRGGRAASFNIIPSSTGAAKAVGKVLPQLNGKLTGMAFRVPTADVSVVDLTVRLEKEASYEDIKAAIKEESEGKLKGILGYTEDDVVSTDFVGDSRSSIFDAKAGIALSKNFVKVVSWYDNEWGYS

SEQ ID NO: 21092 - protein, 307 aa, Actinobacillus pleuropneumoniae serovar 1 str. 4074
MGKIWVTGDAVVDLIPDGENHYLKCAGGAPANVAVGVSRLGVEAGFIGRVGLDPLGKFMQQTLNAEKVSTEHMILDPKQRTSTVIVGLDDGERSFTFMVNPSADQFLEAGDLPTFQKGDFLHCCSIALINDPSRSTTIEAIRRIKAAGGFFSFDPNLRESLWASLEEMKQVVNSVVAMADVLKFSEEELTLLTDTATLEQATKAITAQYPEKLIIITLGKDGAIYHLNGHSQTVAGKALKPVDTTGAGDAFVSGLLAGLSQVENWKDESVLVDVIRKANASGALATTAKGAMSALPNKAELEAFLAQ

SEQ ID NO: 21093 - protein, 147 aa, Fritillaria agrestis
TMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEY

SEQ ID NO: 21094 - protein, 489 aa, GIBBERELLA ZEAE PH-1
MALLSVNLRDGLILTAVITILLYIWEKKTAKITRNGEPLRKPPNTLPLVGNGIIFLQPRQKLFSWFHRCERLYGYETLHITVPSLPPGVIVNDPQNLDFIFRNEGVFEKGEFFKQRSWDLFGHGIINVDGEFWRLQRKAGLRFLSAAALKTLTNEKLPKYLDQAIGVLEAKTNTKEVVDLQAVVHEVTTQLMGRMAYNMEMHADDDFTVAFEHASGGTAERFQNPLWFVTEMFTGARMRRSITTVKAYGKRIVTSAVADRKEAEGKTQSDAPGSLIQSLLDSIGDETLVADAALNYLSAGRDTVAQALTWTLYLLMKNPHVATKLRQSVESLRDEDTSTGDDPELLTPVRLPYVLAVFYESLRLRPPIPFEIKQAQQATTLPDGTFLPAGAIVVWCAWAMGRSHTTWGPNADDFRPERWLTTSLAGDVTVAQRPAAEFPVFNGGPRTLARLVPLFKFEPAFEGERVSKSSLTLPMEGGLPVYVQHQTPS

SEQ ID NO: 21095 - protein, 472 aa, Tribonema aequale
SDRYESGVIPYAKMGYWDADYNVKHTDILALFRITPQPGVDPVEAAAAVAGESSTATWTVVWTDLLTACDIYRAKAYRVDPVPGTTDQFFAYIAYQCELFEEGSIANLTASIIGNVFGFKAVKALRLEDMRIPFAYLKTFQGPATGLVVERERMDKFGRPLLGATVKPKLGLSGKNYGRVVYEGLRGGLDFLKDDENINSQPFMRWRERFLYCVEGINRSSASTGEVKGSYLNVTAGTMEDMYERAEYAKTLGSIIIMIDLVIGYSAIQSMGIWSRKNDMILHLHRAGNSTYARQKNHGINFRVICKWMRMAGVDHIHAGTVVGKLEGDPLMVKGFYHTLLDVTTDVNLPQGLFFAMDWALLRKTVPVASGGIHCGQMHQLLYYLGDDVVLQFGGGTIGHPDGIQAGATANRVALESMVLARNEGRDYLNEGPQILRDAAKMCGPLKTALDLWKDITFDYTSTDTPDFVETA

SEQ ID NO: 21096 - protein, 589 aa, Nostoc sp. PCC 7120
MAIYANNLGIRVSFLPGDSVITQRYAQDMETNYSDKAYRWNRENYSSKRRFVDIWSFVLTLMFKLWRYNKSWSYPGGVTEAKQAARRKAQAVWIRNTLLDLGPTFIKVGQLFSTRADIFPGEYVEELAKLQDKVPAFGYEQVEKIVEQELGKKIPELFHSFEPIPLAAASLGQVHKAVLHSGESVVVKVQRPGLKKLFEIDLQILKGIARYFQSHPKWGRGRDWMGIYEECCRILWEEIDYLNEGRNADTFRRNFRGYDWVKVPKVYWRYASPRVLTLEYLPGIKISQYEAIEAAGLDRKVLARQGAQAYLLQLLNNGFFHADPHPGNIAVSADGALIFYDFGMMGQIKSNIREGLMQTLFGIAQKDGDRVVQSLIDLGAIAPVDDMGPVRRSVQYMLDNFMDKPFENQSVAAISDDLYEIAYNQPFRFPATFTFVMRAFSTLEGVGKGLDPEFNFMEVAQPYAMQLMTDMNGSDSNSFLNELSRQAVQVSTTAFGLPRRLEDTLEKLERGDMRLRVRSIESERLLRRQGNIQIGIGYALIISGFTLSATILLVNHYVWLALLAGLIAAAVSVILIRLLLRLDRYDRMY

SEQ ID NO: 21097 - protein, 310 aa, Staphylococcus saprophyticus
GFGRIGRLAFRRIQNVDGIDVVAVNDLTDDEMLAHLLKYDTMQGRFTGEVEVEKDGFRVNGQEVKSFSEPEPSKLPWKDLDIDVVLECTGFFADKEKAEAHINAGAKKVLISAPATGDLKTIVYNTNHQELDGSETVVSGASCTTNSLAPVAKVLNDDFGLVEGFMTTIHAYTGDQSTLDAPHRKGDKRRARAAAENIIPNSTGAAKAIGLVIPEIDGKLDGGAQRVPVATGSLTELTVVLEKNVSIEDVNAAMKNASNESFGYTEDEIVSSDVIGMTYGSLFDATQTRVMTVGDRQLVKVAAWYDNEMS

SEQ ID NO: 21098 - protein, 95 aa, Glycine max
  unsure (1)..(95): unsure at all Xaa locations
MEMFSSMISFPAVATVNRAGAGMVAPFTGLKSMAGFRTRKTYYVITSIASVGVRVQCMHVWPLIGWKTFATFHYLPDLDDALFAXVVAFLVRKGW

SEQ ID NO: 21099 - protein, 429 aa, Arabidopsis thaliana
MVNSCENKIFVKPTSTTILQDETRSRKFGQEMKREKRRVLRVINQNLAGARVYPCVVNKKGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLMNETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 21100 - protein, 524 aa, Zea mays
MAGGQLNVLTTLDQAKTQWYHFMAIVIAGMGFFTDAYDLFCIALVTKLLGRIYYSDPTSKDPGSLPPNVSAAVTGVALCGTLAGQLFFGWLGDKLGRKSVYGFTLILMVLCSVASGLSFGHTPKGVIATLCFFRFWLGFGIGGDYPLSATIMSEYANKKTRGAFIAAVFAMQGFGILFGTIVALAVSAAFRNAFPAPPYFVDAQASLVPEADYVWRVILMFGTVPAALTYYWRMKMPETARYTALIARNTKQATADMAKVLKKEIEKEDEQVERQVVGADTWGLFSAQFLRRHGLHLLATSSTWFLLDIAFYSQNLFQKDIFTKVGWIPPARTMNAIEEVYRISRAQALIALCGTIPGYWFTVGLIDIVGRFWIQIMGFFMMTVFMLALGVPYEHWTKASNHTGFVVLYGLTFFFANFGPNSTTFIVPAEIFPARLRSTCHGISAAAGKAGAIIGAFGFLYAAQDPKKPDHGYSPGIGIRNTLFVLAGTNFLGMLMSVFVPESKGMSLEEISKENVDDEAEAEV

SEQ ID NO: 21101 - protein, 737 aa, Saccharomyces cerevisiae
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHNSSRVDEDADDDIIFIKEQPIQFSSPLILPSSSSINNNNNIVTSNNPGCGTAATSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 21102 - protein, 199 aa, Buchnera aphidicola
MANILLLDNVDSFTYNLVDQLRKHKHNVLVYRNTVSIQIISQTLMQLINPIVVLSPGPGLPHASGCMLDLIKTVKGQVPIIGICLGHQAIVEAYGGTIEYASEIFHSKVSLIQHDGLEMFKDIPQPLSVASIDSLICNQLPACFIINSSIDNMIMSIRHNADRVCGFQFHPESILTPYGDQILEQIICWSLLKYDSNIK

SEQ ID NO: 21103 - protein, 326 aa, Streptomyces rochei
METRQLLRTMVRIRCIEEEIADVYRDEQQMRTPVHLSIGQEAVAVGVCAALRTEDVVYSGHRCHAHYLAKGGGLGAMVAELYGRETGCAAGRGGSVHLVDEAAGFGASSAILGEMISVATGAAWAFARQEAPRVAVTFFGDGASEEGVFHESLNFAALHRLPVVYVCENNQYSLSSPLAARQPPGTSISGRARGYGIPAARVDGNDVAAVHAAAVTAVEHCRSGTGPYFLELDTYRWREHVGPGWDHECGARRPDEVLSWTKRCPIRRAADALRGADPDVDEWITAWEREFRAETHAAIAAAEAAPFPRVEDLLVGTYGDRGTHAG

SEQ ID NO: 21104 - protein, 376 aa, Odontella sinensis
MKLSIAALLVGSAAAYAPSSFSGTSLKASSNGASMSMSTGMGVNGFGRIGRLVTRIMMEDEDCSLNAINAGSATPDYMAYQYKYDTIHGIAKGSVEIDGDFLVLNGKKIQTSRCRDPKEVGWGALGADYVCESTGVFLTKEKAQAIIDGGAKKVIYSAPAKDDSQTIVMGVNQAEYDGSEDFISCASCTTNGLAPMVKAIHDEFVIEEALMTTVHAMTATQAVVDSSSRKDWRGGRAASGNIIPSSTGAAKAVTKVIPSLQGKLTGMAFRVPTIDVSVVDLTCRLEKATTYEEICAYVKSKAEGDMKGFLGYSDEPLVSTDYEGNTISSIFDADAGIMLNPNFVKLVAWYDNEWGYSCRVVDLMKHVAAVDAKVEA

SEQ ID NO: 21105 - protein, 153 aa, Desulfovibrio desulfuricans G20
MKLKSPIFEQGELLPAANPQHGGESPPLAWEDVPEGTASFVLLCDDPDADGGTATLWMLYNLPADLRSLEAGIADDFAPLKGAAHGINTRGNCRYDAPQPSCHPRRVYYRLYALDSRLSLKAGIARGQLVRAMEGHIISEASLTTVVGSAHTA

SEQ ID NO: 21106 - protein, 407 aa, Pseudomonas putida
  unsure (1)..(407): unsure at all Xaa locations
NEYAPLRLHVPEPTGRPGCQTDFSYLRLNDAGQARKPPVDVDAADTADLSYSLVRVLDEQGDAQGPWAEDIDPQILRQGXRAXLKTRIFDSRXVVAQRQKKXSFYXQSLGEEAIGSGQALALNRTDXCFPTYRQQSILXARDVSLVEXICQLLSNERDPLKGRQLPIXYSVREAGFFTISGNLATQFVQAVGWAXASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASXFEDVYKEXPDHLRRQRQEL

SEQ ID NO: 21107 - protein, 475 aa, Synechococcus sp. PCC 7942
MYEKIQPPSEGSKIRFEAGKPIVPDNPIIPFIRGDGTGVDIWPATERVLDAAVAKAYGGQRKITWFKVYAGDEACDLYGTYQYLPEDTLTAIREYGVAIKGPLTTPIGGGIRSLNVALRQIFDLYACVRPCRYYTGTPSPHRTPEQLDVVVYRENTEDIYLGIEWKQGDPTGDRLIKLLNEDFIPNSPSLGKKQIRLDSGIGIKPISKTGSQRLIRRAIEHALRLEGRKRHVTLVHKGNIMKFTEGAFRDWGYELATTEFRTDCVTERESWILANQESKPDLSLEDNARLIEPGYDAMTPEKQAAVVAEVKAVLDSIGATHGNGQWKSKVLVDDRIADSIFQQIQTRPGEYSVLATMNLNGDYISDAAAAVVGGLGMAPGANIGDEAAIFEATHGTAPKHAGLDRINPGSVILSGVMMLEYLGWQEAADLITKGISQAIANREVTYDLARLMEPAVDQPLKCSEFAEAIVKHFDD

SEQ ID NO: 21108 - protein, 226 aa, Chloroflexus aurantiacus
MPGGTPLLLCLNDVLRRMSTYPIIIGVAGGSASGKTSVAQAILQRVGADRIAHIDHDRYYKDLSHLPLEERAKFNFDHPDALDNDLLVAHLDALCAGQSVDLPTYDYATYVRLPQTERIEPRPVILVEGILIFYEPVLRRRMQIKLFVDTDADLRFIRRLRRDIVERGRSVESVIEQYLATVRPMHLEFVEPTKRYADVIFPGGGRNPIAIDMVVARIEAALQATP

SEQ ID NO: 21109 - protein, 429 aa, Glycine max
  unsure (1)..(429): unsure at all Xaa locations
MKTKLLLLMLLMLLLILHKPTWILASAYPLAPSPQVPPFSPFPTSMSASSPGHLVQIIYRIVMGAEQQHMDSHKKMVIAVAVASTSLGAVILCVLCIWIYYTKYPSKSKGKNVQRSDAEKGLASSPFLSKFSSIKLVGKKGCVPIIDYKQIEKTTGNFEEINILGEGGFGCVYKAHLDDNLDVAVKKLHCENQYAEQEFENEVDLLSKIQHPNVISLLGCSSNDDTRIIVYELMHNGSLETQIHGPSHGSALTWHLRMKXILLTQPGGLKYLHEHCYPPVIHRDLKSSNVLLDTKFNAKLSDFGLAITNGSQNKNNLKLSGTLGYVAPEYLLDGKLTDKSDVYAFGVVLLELLLGKKPVEKLAPAQCQSIVTWAMPLLTDRSKLPNIVDPVIKNTMDPKHLYQVLVPRSQNSLRHIFQFITTYPFWGMI

SEQ ID NO: 21110 - protein, 131 aa, Triticum aestivum
MAGASSWSSSCSCTSSLGSLDDDDVFCVVKPGSPGAAAEGSVKFLCSYGGMILPRHPDGALRYVGGNNRVLSVDRSLQFHELQRKLTDMCGWEALSLRCQLPTEDLDALVSVTTNDDLGHLLEEYDAASRR

SEQ ID NO: 21111 - protein, 135 aa, Haemophilus influenzae
EDPTPALEGADVVLISAGVARKPGMDRSDLFNINAGIVRGLIEKVAVTCPKACVGIITNPVNTTVAIAAEVLKKAGVYDKRKLFGVTTLDVLRSETFVAELKGLNVSRTSVPVIGGHSGVTILPLLSQVQYAEWN

SEQ ID NO: 21112 - protein, 127 aa, Oryza sativa
  unsure (1)..(127): unsure at all Xaa locations
YSVNEGHAXTGNGPTTKYVKKCRFPKDGSFAKSLRYVGSMVADVHRTLLYGGIFLYPADKKSPNGKLRVLYEVFPMSFLMEQAGGQAFTGKKRALDLVPEKIHERSPIFLGSYEDVEEIKALYAAEE

SEQ ID NO: 21113 - protein, 536 aa, Saccharomyces cerevisiae
MTEDNIAPITSVKRLVTDKCTYKDNELLTKYSYENAVVTKTASGRFDVTPTVQDYVFKLDFEKKPEKLGIMLIGLGGNNGSTLVASVLANKHNVEFQTKAKGVKQPNYFGSMTQCSTLKLGIDAEGNDVYAPFNSLLPMVSPKHFVVSGWDINNADLYEAMQRSQVLEYDLQQRLKAKMSLVKPLPSIYYPDFIAANQDERANQCINLDEKGNVTTRGKWTHLQRIRRDIQNFKEENALDKVIVLWTANTERYVEVSPGVNDTMENLLQSIKNDHEEIAPSTIFAAASILEGVPYINGSPQNTFVPGLVQLAEHEGTFIAGDDLKSGQTKLKSVLAQFLVDAGIKPVSIASYNHLGNNDGYNLSAPKQFRSKEISKSSVIDDIIASNDILYNDKLGKKVDHCIVIKYMKPVGDSKVAMDEYYSELMLGGHNRISIHNVCEDSLLATALIIDLLVMTEFCTRVSYKKVDPVKEDAGKFENFYPVLTFLSYWLKAPLTRPGFHPVNGLNKQRTALENFLRLLIGLPSQNELRFEERLL

SEQ ID NO: 21114 - protein, 468 aa, Chorda rigida
IPYAKMGYWDADYNVKDTDILALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPYAYLKTFQGPATGVIVERERLDKFGRPFLGATVKPKLGLSGKNYGRVVYEGLCGGLDFLKDDENINSQPFMRWKERFLYCMEGVNRAAAATGEVKGSYLNITAATIEQMYERAEYAHSIGTVIVMIDLVIGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALESMVLARNEGRDYVGEGPENLRNAASTCGPLKAALDLWKDITFDYTSTDTPDFVEQATESK

SEQ ID NO: 21115 - protein, 267 aa, Arabidopsis thaliana
MEERHKCKLCWKSFANGRALGGHMRSHMLIHPLPSQPESYSSSMADPGFVLQDRESETESSKKPSRKRSRLNRRSISSLRHQQSNEEGKSETARAADIKIGVQELSESCTEQEPMSSVSDAATTEEDVALSLMLLSRDKWEKEEEESDEERWKKKRNKWFECETCEKVFKSYQALGGHRASHKKKIAETDQLGSDELKKKKKKSTSSHHECPICAKVFTSGQALGGHKRSHASANNEFTRRSGIIISLIDLNLPAPSEEEEMASSVF

SEQ ID NO: 21116 - protein, 587 aa, Prochlorococcus marinus subsp. pastoris str. CCMP1378
MTLTSTSLSKDDSEKNYPIWITGAEALMDSLKVHDVKVIFGYPGGAILPIYDAVHKAENDGWLKHYMVRHEQGGSHAADGYARSTGEVGVCFGTSGPGATNLVTGIATAQMDSVPLVVVTGQVPRPAIGTDAFQETDIFGITLPIVKHSWVVRDPSDIAKVVSEAFFIASSGRPGPVLIDIPKDVGQEFFNYERILPGKIIPKGFKRNGEINDADINQAIELIQESSRPLLYVGGGAISSGAHEEVETLANNYQIPVTTTLMGKGVFDERDDLSVGMLGMHGTAYANFAVTECDLLIAVGARFDDRVTGKLDTFAPSAKVIHIDIDPAEVNKNRRVDVAIVSDVAKALSKINEKYFNNKTSCNTKNWLEKINFWKNKHPLFVPPEEGEIYPQEVLLKVRDFAPEAFITTDVGQHQMWAAQYLRNAPRRWISSAGLGTMGFGLPAAMGVKAALPNEEVICIAGDASVLMNIQELGTLSQYGLNIKLVIINNRWQGMVRQWQESFYEERYSSSDMSCGEPDFVKLAESFGVKGFLISERKQLLNEFKSALDFDGPALINVRVRRGENCYPMVPPGKSNAQMVGYVNSES

SEQ ID NO: 21117 - protein, 563 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASTNAKQ

SEQ ID NO: 21118 - protein, 409 aa, Arabidopsis thaliana [sequence omitted]

SEQ ID NO: 21119 - protein, 458 aa, Streptococcus agalactiae 2603V/R
MAYKTIYPYTNEVLHEFDNISDSDLEQSLDIAHALYKTWRKEDNVEERQNQLHKVADLLRKDRDKYAEVMTKDMGKLFTEAQGEVDLCADIADYYADNGQKFLKPVPLESPNGEAYYLKQAVGVLLAVEPWNFPFYQIMRVFAPNFIVGNTMLLKHASICPASAQAFEDLVREAGAPEGAFKNIFASYDQVSNLISDPRVAGVCLTGSERGGASIAAEAGKNLKKSSMELGGNDAFLILDDADFDLLSKTIFFARLYNAGQVCTSSKRFIVMADKYDEFVNMVVETFKSAKWGDPMDSETTLAPLSSAGAKDDVLKQIKLAVDHGAEVVFGNDTIDHPGNFVMPTVLTNITKANPIYNQEIFGPVASIYKVDTEEEAIALANDSSYGLGSTVFSSDPEHAKKVAAQIETGMTFINSGWTSLPELPFGGIKNSGYGRELSQLGFDAFVNEHLVFTPNSD

SEQ ID NO: 21120 - protein, 359 aa, Haemophilus somnus 129PT
MAKLLDIVKPGVLTGDDVQKVFAYAKANNFAIPAVNCVGTDSVNAVLETAARVKAPVIIQFSNGGAAFYAGKGIKPASGIRPDVLGAIAAAKHVHTLAAEYGVPVILHTDHAAKKLLPWIDGLLEAGEKHFAETGKPLFSSHMIDLSEEPMAENMAICREYLARMDKMGMTLEIEIGITGGEEDGVDNSDVDESKLYTQPEDVLFVYDQLSPISPRFTIAAAFGNVHGVYKPGNVKLKPSILGASQEFVSKERNLPAKSLDFVFHGGSGSSTEEIREAISYGAIKMNIDTDTQWATWEGVLNFYKANEAYLQGQLGNPEGPDAPNKKYYDPRVWLRKAEESMSKRLEKSFEDLNCVDVL

SEQ ID NO: 21121 - protein, 294 aa, Sesbania rostrata
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 21122 - protein, 585 aa, Mesembryanthemum crystallinum
MGGSNALNEMTNGSDGITGGVADVYGEEFATQDQLVTPWSFSVACGHSLLRDPQHNKGLAFTEKERDAHFLRGLLPPVVLSQELQEKKFLTTLRQYQVPLQKYMAMMDLQERNEKLFYKLLVDHVEELLPLVYTPTVGEGCQKYGSIFRRPQGLFISLKDKGRILELLRNWPEKKIQVIVVTDGERILGLGDLGCQGMGIPVGKLSLYSALGGVCPSACLPITLDVGTNNQKLLDDEFYIGLKQKRATGEEYAEFVQEFMSAVKQNYGEKILVQFEDFANHNAFELLEKYRTTHLVFNDDIQGTASVVLAGLIASLKLLGGTLADHKFLFLGAGEAGTGIAELIALEMSKKTKAPVEQMRKKIWLVDSKGLVVSSRKETLQQFKLPWAHEHEPITTLIDAVQAIKPTVLIGTSGKGKQFTKEVVEAMANINAKPLILALSNPTSQSECTAEEAYTWSQGHAIFASGSPFDPVEYEGRTFVPGQANNAYIFPGFGLGLIMCGAIRVHDDMLLAASEALASQVTGEHFIKGLIYPPFKDIRKISAHIAAGVAAKAYELGLASRLPQPADLVKFAESCMYNPTYRSFR

SEQ ID NO: 21123 - protein, 251 aa, Triticum aestivum
MMGYQKGVDIEAGTSGGTGTAAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 21124 - protein, 458 aa, Porphyra dioica
ADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGEIKGHYLNVTAATMEDMYERAEFSKVVGSIICMIDLVIGYTAIQSMAIWARKNDMILHLHRAGNSTYSRQKNHGMNFRVICKWMRMAGVDHIHAGTVVGKLEGDPLMIKGFYNTLLESETDINLPQGLFFAQDWASLRKVVPVASGGIHAGQMHQLLDYLGDDVVLQFGGGTIGHPDGIQAGATANRVALESMVMARNEGRDFVGEGPQILRDAAKTCGPLQTALDLWKDISFNYTSTDTADFVETPTANV

SEQ ID NO: 21125 - protein, 461 aa, Rhodophyllis volans
YWDPDYVIKETDILALFRVTPQPGVDPIEASAAVAGESSTATWTVVWTDLLTACDLYRAKAYKVDAVPNTSDQYFAFIAYDIDLFEEGSIANLTASIIGNVFGFKAVKALRLEDMRIPYAYLKTFQGPATGIISERERMDKFGRPFLGATVKPKLGLSGKNYGRVVYEGLRGGLDFLKDDENINSQPFMRWKERYLYAMEGVNRSVAATGEIKGHYLNVTAATMEEMYGRAEFAKQLGSIIIMIDLVIGYTAIQTMGIWARRNDLILHLHRAGNSTYSRQKIHGMNFRVICKWMRMAGVDHIHAGTVVGKLEGDPVMIRGFYNTLLLPYLDVNLPQGIFFEQDWASLRKVTPVASGGIHCGQMHQLLDYLGVDVVLQFGGGTIGHPDGIQAGATANRVALESMVLARNEGRDYVAEGPQILQDAAKSCGPLQTALDLWKDITFNYTSTDTADFVETPTANV

SEQ ID NO: 21126 - protein, 338 aa, Streptomyces coelicolor A3(2)
MGESVLLTSTPPEHKESVIVSSAPQSRPWDVHRLPSAEGRNFLVTGGNAGIGYFTAEQLAATGALVVIGSRNPAKADAALASIRSRVPGARVRHLHLDLADLSTLKSAVDGLALDLGRLDAVVHNAGGALDDPPRRETEDGHELMFGTNHLGHYALTRWLAPLLSAAPAGRVVTVGSFAARSERLDLDDLQSTRDYRPKRTYGRSKLAQMCFGFELDRRLRAAGSTVLSAVAHPGGALDSLTPPRPPVGAPTPGERLRGLPAALMVQGKDAGAWPVVRAVLDSDVQGGQLWGPRVFGLRGQPRREPVPAHMADPAVAARLWAASAELTGTTDPHLGFR

SEQ ID NO: 21127 - protein, 511 aa, Nicotiana tabacum
MALLDLQLSTSLLFCLVPLLFLFFVKFKKTITNTLLSSNNSSKIPRSYPLIGSYFSILANHDRRIKWISDIILTTPNLTFTLIRPLNFRTIFTANPSNVQHVLKTNFQVYQKGHGSYSTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFIVPFSLIWKIKRALNIGSEKKLRVAVEQVREFAKEIVREKQKELNDKSSLDSADLLSRFLSTGHSDEDFVTDIVISFILAGRDTTSAALTWFFWLISKHPEVESQIMKEVGEKSESLLLYDEVKNMMYTHASLCESMRFYPPVPMDSKEATKDDILPDGTFVKKGTRVTYHPYAMGRVEKVWGEDWAEFKPERWLDKDEVTGNWTFVPKDAYTYPVFQAGPRICLGKEMAFLQMKRVVAGVLRRFKVVPVVEQGVEPVFISYLTAKMKGGFPVTIEERI

SEQ ID NO: 21128 - protein, 350 aa, Citrus unshiu
MADNHNPTSGAGSKDLSASMDGGSGAYDRLVVCFGEMLIDFVPTVGGVSLAEAPAFKKLLCAPANVAVGISRLGGSSAFVGKLGDDEFGYMLANILKENNVDTSGVRYDSTARTALAFVTLRADGEREFLFFRHPSADMLLCESELDKNLIKQGSIFHYGSISLIAEPCRSTQLAAMNLAKESGSILSYDPNLRLPLWPSEEAAREGIMSIWDQADIIKVSDDEITFLTGGDDHNDDHVVLEKLFHPNLKLLIVTEGSKGCRYYTKEFKGRVPGVKTKAVDTTGAGDSFVSGILNCLAADQNLIKDENRLREALLFANACGALTVTERGAIPALPTKEAALKLLHTVAAL

SEQ ID NO: 21129 - protein, 208 aa, Zea mays
MPQYQELPCGGQVLDIDTALKDGILGGALEPEDAAAGDAGKQPVELRKMMDELDAAGDGGGDEAVPAVFICPISLEPMVDPVTLCTGQTYERANISRWLALGHRTCPTTMQELWDDALTPNATLRQLIAAWFSRRYTRFKKRSADFHGRAADLVHGLRGTAMPRRQALKGQARVAALRELRALATAHQSVTKAIAEAGGVVLKDTLGV

SEQ ID NO: 21130 - protein, 552 aa, GIBBERELLA ZEAE PH-1
MGLTINNIFAVNEDRPTPKAVYNWRVYTCAAIASFASCMIGYDSAFIGTTIALPSFTAEFDFASYEPDALALLKANIVSVYQAGAFFGSLFAYVTSYFIGRRYSLIAFSFVFMLGAGMMLGANGDRGLGLIIGGRVLAGVGVGACSNMVPIYCSELSPPAIRGRLVGIYELGWQIGGLVGFWINYGLAETMAPSHKQWIIPFAVQLIPAGMLLFGAFWIKESPRWLFAKGRREEAMKNLCWLRQLPADDLYIVEEVSYMDQELERYNREVGPGFWKPFSCLKSRNIQWRFFLGGMMFLWQNGSGINAINYYSPTVFKSIGITGTNTGFLTTGIFGVVKTTVTIIFILFLIETVGRRKLLIIGSVGGSLCMWFIGAYIKVANPAGKVAAAEAAGTAAPGMSSGGIAAVFFFYLWTVFYSPTWNPIPWVLNSEMFDEKSRSLGQASAAANNWFWNFIVSRFTPQMFIKMGYGVYFFFASLMIMSATFVFFFIPETKGLPLDTMNRLFEIKPVWKAHGQLSQELRDQEEEFRRNAEGSKISDEKAQAIADEREDV

SEQ ID NO: 21131 - protein, 291 aa, Vitis labrusca x Vitis vinifera
MAPLLCLLILMITTCSDAQGPPSPGFSPSSKFSPISFNQGFRNLWGSQHQTIDQGLLTIWLDSTSGSGFKSLKPYRSGYFSAAIKLQPGYTAGVITSFYLSNNEDYPGNHDEIDIEFLGTTLDKPYTLQTNVYMKGSGDGRLIGREVKIHLWFDPTEDFHNYAILWTPDEIIFLVDDVPVRRYPRKNDATFPARPMWVYGSIWDASSWATEDGKYKADYRYQPFVGRYKNFKLGGCTTDAAASCRPPSISPSSAEGLSQQQYSAMESVQKNYVVYDYCQDPKRDHSQIPEC

SEQ ID NO: 21132 - protein, 165 aa, Rhizobium etli
MNPLQTDAQTLLRGVKDLLESTPISAEKCHLGVAPVAIALTQVQAELASAVRPVYTVAQDVSRIAGMGAYTGEVSAELLADSGIGYVLVGHSERREIFGESREILNTKIKNALNAGLTVIYCVGESLEQREAGQAEAVVLQQICDIAAVVEAEQWKNIVIAYEPI

SEQ ID NO: 21133 - protein, 236 aa, Zea mays
MPSQSTHTSSSLSSSTAPILPCSSAAALFRSVMAAVATETPFHVLAVDDSLPDRKLIERLLKTSSFQVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTIGSSSDSINNRKRKGAGTEEILPQLANRSRHS

SEQ ID NO: 21134 - protein, 711 aa, Azotobacter vinelandii
MCARRTLHGARAAFPYPAECRRPTPGRQLAGRGRLHPARARREPAAPGRQPAENRRPAQPRSQPGRRQQQPAGTRRNPPGSRAGLGIRAVALARPGGHPVARRQPAAQRALGRTEPRQPAPEPGRLPRRRVEYPGRPPRSRGPFRRSRRPPPGHGPPRGAHRPPHPPTGIQRQRMKLLAVRRLLRIQSVVVRYRLDDLLFDQPLLPWWLRALGYLLPWRWLPRRRSEQPRAVRLRLALQDLGPIFIKFGQILSTRRDLLPEDIADELTWLQDRVPPFNPQQSVALIEEQLGARVDEAFARFDSEPLASASVAQVHAAQLKTGEEVVVKVVRPGLKAVIRQDLAWLYLFARLAERASTEARRLHLVDVVSDYEKTIYDELDLLREAANASQLKRNFEGSPLLYVPQIYWDWCRPKVLVMERIYGVPVTDLAALVDQGTDLKLLAERGVEIFFTQVFRDSFFHADMHPGNIFVSTRQPWDPQYIAIDCGIVGSLTPQDQDYLARNLLAFFKRDYRKVAQLHIDSGWVPADTQVNEFEAAIRTVCEPIFEKPLKDISFGQLLLRLFQTARRFNMEVQPQLVLLQKTLLNIEGLGRQLYPELDLWTTAKPFLERWMRKRMSPKAMLDNLQGQLEQLPHLAQMTRTALEDISRPAWDTRKRERHDHHLLRLLGAALLAGGVLLALQTPPTSANAWPSWLMLASGLYLLVGRRRLSD

SEQ ID NO: 21135 - protein, 293 aa, Oryza sativa (japonica cultivar-group)
MEMTRSLTLVPLPATLRPASAACRRRRRRRGLPFGALFSPSPPSNQQQQEMHIRALQPRQDWVGEWVRSNDTLVRGLPILGGGASLLAVLLNRAVSGIAAVADASSSQSRADILTLALSVTDILAGLVWLSIRPKSISPVVPRGVECKRVGTGVLDSALRELLWTWDSLTTATCCKSLVVVYGGNCVLQIGVAAGSPEDGNAVMVDAQKFMQGSLYRSAMESKKQSYLANLALYPGRTELPFLPANTQALILQPIGDKGIAVIGGDTIRGFTNLDQAWIAMIADKLDATLSKS

SEQ ID NO: 21136 - protein, 285 aa, Streptomyces aureofaciens
MSDRTERVWLITGASRGLGRAIAEVVLEAGDTVVATARSIPALDGLVERFGERVVPVALDVTDRAAVLAAVAEAAERTGRIDVLLNNAGYGLAGAVEEVNETQVRDQFDVNFFGALWVTQAVLPVMRRQGSGHLLQMSSIAGVTTYPNLGLYCASKWALEAVSETLAQEVAGFGVKVTLVEAGEFRTDWSAGSMVRATPKFAYDEVLAKRRHGLSGAYAHLQPGDPRKAGEALLKLTDEAEPPLRVLLGEGAADLAPNVLRARLAGWEEWDALARTTDFPAESGP

SEQ ID NO: 21137 - protein, 505 aa, Hordeum vulgare
MAAPPAIPRRGLFIGGGWREPTLGRHIPVINPATEDTIGDIPAATAEDVELAVAAGGPVLARRREPWARASGATRAKYLNAIAAKITGKIAYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVTFDDVADIDKAVEWPMLGCFFNGGQVCSATSRLLLHEKIAEPFLDRLVEWAKNIKISDPLEEGCRLGSVISKGQYEQIKKFISTARSEGATILHGGDRPKHLGKGFFIEPTINTGVSTSMQIWREEVFGPVICVKVFKTESEAVELANDTHYGLAGGVISDDLERCERIAKVIHSGIVWKNCSQPTLVQAPWGGNKRSGFGRELGEWGLENYLSVKQVTRYCKDELYGWYQRPSKL

SEQ ID NO: 21138 - protein, 357 aa, Fusobacterium nucleatum subsp. nucleatum ATCC 25586
MKDLHGGNIYKFQREGKNNILDYSSNINPLGVPQKFIDIAKENFDKLVNYPDPYYIELRKKIAEFNSLNMDNVIVGNGATEILFLYIRALKPKKVLILAPCFAEYARALKSVSAKMEYFELKESDNFYPNIINLKKEIENNNYDLLLFCNPNNPTGQFIKLEDIKEIVKTCENKNTRIFIDEAFIEFIENWKEKTVSLLKNRNVFIMRAFTKFFAIPGLRLGYGLGFDENILKKMWEEKEPWTVNTFANLAGLTMLDDKEYIKKSEKWILEEKKFMYKELSDFQYIKAYKTECNFILLKIYNISSASLRDKMIEKNILIRDASNFKFLDFHFVRLAIKDRESNLKLLETLDTIMEYK

SEQ ID NO: 21139 - protein, 200 aa, Synechococcus sp. PCC 7942
MLLVIDNYDSFTYNLVQYLGELASDYAIAQEIVVHRNDQIDLAGIAALKPDAIVISPGPGRPEDAGISMAAIAEFGPTTPILGVCLGHQSIGQVYGGQIVSAPELMHGKTSPVLHHDVGVFQGLDNPITATRYHSLVIDRDSCPADLEVTAWVEDGTIMGVRHRQYPHVEGVQFHPESVLTQSGKRMLANFLAKVPSPEC

SEQ ID NO: 21140 - protein, 451 aa, Desulfitobacterium hafniense
MSISTQFSVPQRMERLPLTSYQKKIFYIIATAWFFDSMDLGMLTFVLGSIKTDLGLTTVQAGLLSSFSFLGMFFGAASAGMAADKFGRKIVFQTSMILWGAASIACAFTQNVEQLALARFFLGLGMGMEFPIGQSLISEFIPAKNRGRYIALLEGFWPIGFIAAGILSYFLLPIGGWRLVFLCEGIPAIFVLIIRRMVPESPRWLADTNQDEKADVVMTAFEKNVEKAYGKELPPPIKDDNLVIGKHEKKFSFLQLWAPGYKKRTIMVWLLWFFALLGYYGLTTWLSAFLQEAGYSVTKSVYYTIMISLAGIPGFFSAAYFIEKNGRKPTLIVVLIGCAVFAYLYGTASSLQTLIGFGLGMQFFLFAMWSSLYAYTPELYPTRARATGTGFASSVGRFGSLLGPYIVAVVLPTLGNSGVFALGAACFIAAALSVAILGEETKGRVLEEISA

SEQ ID NO: 21141 - protein, 682 aa, Magnaporthe grisea
MLRTVGRKALRGSSKGCSRTISTLKPATATIAKPGSRTLSTPATATATAPRTKPSASFNARRDPQPLVNPRSGEADESFIGKTGGEIFHEMMLRQNVKHIFGYPGGAILPVFDAISNSEHIDFVLPKHEPGAGHMAEGYARASGQPGVVLVTSGPGDTNVITPMADALADGTPLVVFSGQVVTSAIGSDAFQEADVIGISRSCTKWNVMVKSVDELPRRINEAFEIATSGRPGPVLVDPAKDVTASVLRRAIPTETSIPSISAAARAVQEAGRKQLEHSIKRVADLVNIAKKPVIYAGQGVILSEGGVELLKALADKASIPVTTTLHGLGAFDELDEKALHMLGMHGSAYANMSMQEADLIIALGGRFDDRVTGSIPKFAPAAKLAAAEGRGGIVHFEIMPKNINKVVQATEAIEGDVASNLKLLLPKIEQRSMTDRKEWFDQIKEWKEKWPLSHYERAERSGLIKPQTLIEELSNLTADRKDMTYITTGVGQHQMWTAQHFRWRHPRSMITSGGLGTMGYGLPAAIGAKVARPDALVIDIDGDASFNMTLTELSTAAQFNIGVKVIVVNNEEQGMVTQWQNLFYEDRYSHTHQRNPDFMKLADAMDVQHRRVSKPDDVGDALTWLINTDGPALLEVMTDKKVPVLPMVPGGNGLHEFITFDASKDKQRRELMHTRSNGLRG

SEQ ID NO: 21142 - protein, 180 aa, Griffithsia japonica
GTRIHRPAPTNRPSRTTRAQSRPFFTMGVDSYDPRVTHQLLELLYRHVSTVLLDARVCCDHADKPAIDADDVKLALRSRNTFTFTQPPPRDVTMRLAAERNAVPLPPIDARAGVALPPELGQLTRQNYRVMTQSNRPAKRSRLSQSPAARASYASYARPPRPPTGTEVIDLDAPMQQEAR

SEQ ID NO: 21143 - protein, 242 aa, Symbiodinium sp. JCUCS-1
LEYMVYQLKYDSVHKTFGGTIAAKKDGGKEFLVVNGKDIAVFHEKDPAAIKWGESGAEYVCESTGIFTTQEKAALHIGGGAKKVIISAPPKDSVPMYVMGVNHENYKSTDTVVSNASCTTNCLAPLTKVVHENFGIIEGLMTTVHAMTATQLTVDGPSRGGKDWRGGRRASQNIIPSSTGAAKAVGKVIPDMNGKLTGMAFRVPTPDVSVVDLTCRLSKPAKYEDIVKAIKDAAAGPMKGVL

SEQ ID NO: 21144 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 21145 - protein, 89 aa, Zea mays
LGKALFNGLPNPFTAARYHSLVIEKETFPHDALEATAWTEDGLIMAARHKKYKHIQGVQFHPESIITPDGKKIILNFVRFIEELEKQRS

SEQ ID NO: 21146 - protein, 321 aa, Isochrysis galbana
SKVGINGFGRIGRQVVRIAMDRDAFVLKHINSPMTPEYMKYLLEHDTVHGRFPGTCEVNKDGLVINGLPVSLSSTRDPTEIPWGKVGVEYVCESTGAFLSTPDCLKHIAGGAKKVIISAPAKDAETPTIVVGVNTDTYDPETMNVVSCASCTTNGLAPLVKTINDKFGIKQGLMTTVHAATASQVVVDSSMKGADWRAGRAASANIIPSSTGAAKAVAKCYPVMKGKLTGMAFRVPTVDVSVVDLTCELETPCTYDEIKAEVKLASETYAKGIVGYTEDQVVSSDFVGETCSTVFDAGAGIQLTPTFVKLVSWYDNEWGYS

SEQ ID NO: 21147 - protein, 392 aa, Glycine max
MEGGGAAPPADTVMSDAAPPPQQPPVAMGIENIPATLSHGGRFIQYNIFGNIFEVTAKYKPPIMPIGKGAYGIVCSVLNSETNEHVAIKKIANAFDNKIDAKRTLREIKLLRHMDHENVVAIRDIVPPPQREIFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRKRITVEDALAHPYLTSLHDISDEPVCLTPFSFDFEQHALTEEQMKELIYREALAFNLEYQQ

SEQ ID NO: 21148 - protein, 143 aa, Zea mays
  unsure (1)..(143): unsure at all Xaa locations
AGTRAGTGRASHGRPIAIRSVLRGRRDPTGRQGCIQAHPEWWVSTCTFWSTSFGAPXWERSTHALTEGHXGPMIREDHHLMEKLAQFDRXRILERDAHERGGRVKGFCEDTHDVCHLTCADFIRAPGVQTPGIVRFCTEVHER

SEQ ID NO: 21149 - protein, 252 aa, Triticum aestivum
MMGYQKGVDIEAGTSGGGTGTTAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 21150 - protein, 144 aa, Escherichia coli
MIFLPLTVAEDDWAGWKILHGALGEQIELVGDDLFVTNVKYIQRGIDENLANSALIKLNQIGSLSETFDAVQLCHDNNWGTFISHRSGETVDSFIADMTVAMRAGHLKTGAPCRGERIEKYNQLMRIEDELGSSAQFAGKSAFK

SEQ ID NO: 21151 - protein, 299 aa, Vibrio fischeri
RALYESDKRDKVEVVAVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVKASRCTLHNIVDYTEAPLVSIDFNHDPHSAIVDGSQTRVSNGHLVKM

SEQ ID NO: 21152 - protein, 317 aa, Saccharomyces cerevisiae
MSTLLERTKSVQELKKRAAGKTSANPAEVAKAKKVLRRLYSWDEIPEWQRDNDFILHGYVKETSSFIETFKSLFYLHNESVNIYSHLIPALGFFTVLLLDKSTIKVFATTTWLDHMVIDLFYSGAFACLILSSSFHCLKSHSLRIATLGNKLDYLGICILIVTSMVSILYYGYFEKFSLFCLFALITVSFGIACSIVSLKDKFRKREWRPYRAGLFVCFGLSSIIPIFSGLYCYSFSEIWTQIQLFWVLLGGVLYIIGAVLYGMRFPEKICPGKFDIWGHSHQLFHFLVVIAALCHLRGLLNSYELVHIKMENGIVS

SEQ ID NO: 21153 - protein, 63 aa, Prorocentrum minimum
MRGILTDWLVEVAEEYKLCADTLYLSVNYIDRFLSIHPVQRSNLQLVGIACMWIASKYEEIYP

SEQ ID NO: 21154 - protein, 329 aa, Streptomyces clavuligerus
MPVLMPSAHVPTIDISPLFGTDAAAKKRVAEEIHGACRGSGFFYATNHGVDVQQLQDVVNEFHGAMTDQEKHDLAIHAYNPDNPHVRNGYYKAVPGRKAVESFCYLNPDFGEDHPMIAAGTPMHEVNLWPDEERHPRFRPFCEGYYRQMLKLSTVLMRGLALALGRPEHFFDAALAEQDSLSSVSLIRYPYLEEYPPVKTGPDGQLLSFEDHLDVSMITVLFQTQVQNLQVETVDGWRDIPTSENDFLVNCGTYMAHVTNDYFPAPNHRVKFVNAERLSLPFFLNGGHEAVIEPFVPEGASEEVRNEALSYGDYLQHGLRALIVKNGQT

SEQ ID NO: 21155 - protein, 515 aa, Penicillium italicum
MDLVPLVTGQILGIAYYTTGLFLVSIVLNVIKQLIFYNRKEPPVVFHWIPFIGSTIAYGMDPYQFFFASRAKYGDIFTFILLGKKTTVYLGVEGNEFILNGKLKDVNAEEVYGKLTTPVFGSDVVYDCPNSKLMEQKKFIKYGLSQEALESYVPLIADETNAYIKSSPNFKGQSGTIDLAAAMAEITIFTAARTLQGEEVRSKLTSEFADLFHDLDLGFSPINFMLPWAPLPHNASAIKHTTYARDLSGNYPSATGSWRRRQRRRQDKSKGTDMISNLMRCVYRDGTPIPDKEIAHMMITLLMAGQHSSSAISCWILLRLASQPEMAEKLHAEQIKNLGADLPPLQYKDMDKLPLLRNVIKETLRLHSSIHTLMRKVKNPMPVPGTDFVVPPSHTLLSSPGVTARDERHFRDPLRWDPHRWESRVEVEDSSDTVDYGYGAVSKGTRSPYLPFGAGRHRCIGEKFAYLNLEVIVATLVREFRFFNPEGMEGVPDTDYSSLFSRPVQPATVRWEVRS

SEQ ID NO: 21156 - protein, 288 aa, Glycine max
IRLEGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 21157 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 21158 - protein, 515 aa, Oryza sativa (japonica cultivar-group); identical to SEQ ID NO: 1985

SEQ ID NO: 21159 - protein, 418 aa, Glycine max
  unsure (1)..(418): unsure at all Xaa locations
LLLSLSVAIFTSACQYGGRFLAKCTPCDPSLSDVCPTNGRSGNFKQFNCPKGYYNDLATLLLTTNDDAVRNIFSTNTGSRXPLEYQPLSLLIFFLLYCILGLITFGIAAPSGLCLPIILMGXGYGRLLGIYMGPHTNIDQGLFAVLGAASLMAGSMRMTVSLCVXIFLELTNNLLLLPITMIVLLIAKTVGDSFNPSIYEIILHLKGLPFMDANPEPWMRNLTVGELVDVKPPVVTLHGVEKVAKIVDALKNSTRXFFPVMDNGVVPPVVGQANGGTNXNGLILRAHLIQAIKKKWFLKERRRXEEWEVREKFTWVELAEREGSIEEVAVTSEEMEMFVDLHPLTNTTPFTVLESMSVAKAMTLFRQVGLRHLLVVPKYQASGISPVIGILTRQDLLAHNILTVFPHLAKSKGREKTN

SEQ ID NO: 21160 - protein, 341 aa, Ralstonia eutropha
MAQTMRAMIFEGAGLPLRLQDVPVPDPGPGEVCIAAAACEVCHTDLHIADGDLSHPKPALIPGHEAVGQVESCGTGVTAFSPGERVGVPWLGNTCGDCRYCMHLHGNLCDAPQLTGYTRDGGYAEYVVADSSYYFRIPPAYDDEHAEPLLCAGLIDYRTLRMAGEAQRIGIYGFGAAAHLVTQIAAAQGREVYGFTRAGDTGAQQLAYETGACWAGSSDLQSPVALDAALIFAPVGALVPCALRAVDKGERCRLRRHPHERHPAHALPAAMGRASPVFGRQPHARRRNCVDADRRPDAAADAHDRLPARAGQCGTGRSARGASVRCRRPENPSLRLRQISP

SEQ ID NO: 21161 - protein, 375 aa, Arabidopsis thaliana
MPLSLQSPPCATLSASIRKGRWKTLAAGFSVTPLPAVNFSLRRSIPRILASASSSSSPASSSLEAGENNELNAVSAFSEIVPDTVVFDDFERFPPTAATVSSALLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAASQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPDDEKYSFVRKLTPETATHYHFTNKELVKWDQLSLSSSMGPASV

SEQ ID NO: 21162 - protein, 292 aa, Triticum aestivum
  unsure (1)..(292): unsure at all Xaa locations
RFTSPLPEPSPRQASAAVTAPSTAPASSSALCTPEERARTRGASQDGECDHMVELANGXKLEKSMVADNGPGKSVQXSEVRTRSGAFLGSKRXDEVVARIEEXLLLGTFLPSENGESIQILHYKNGEXYEPHYDYFXDKNNQALGWSTEVATVLSEVSNIEKGGETIFPNAEGKLTQHKDETASECAKNGYAVKPVKGNALLFFSLHPEATTDPDSLHGSCPVIEGQKWSATKWSHVRSFENSGKQGGGCEDENVLCSQWAAVGECAKNPNYMVGTKEAPGFCSKSCNVCAQ

SEQ ID NO: 21163 - protein, 689 aa, Neurospora crassa
MPAQTSFPSLAALRRLQTLNHVYAPLRRTGTGRITNGWTCASCRSQLSASSASSSSSSSSLSVSLYNSTLARRSFSSSSKRSSDQNSNGSSSSSSSSSSSNGNGKTNNNNNNNNNNGRRTVLLAAGGGAAAAGLLAVGDDVKYTYEAVERTGRVASTLAICVNDYRVTLNAREKIEDPEEKQRLLRECHQRCADRTLEVLEKSGGIFIKLGQHLSAMNYLLPPEWTTTFIPLQDKCPVSSFESIERMFLEDTGTSLWDYFSEFSREPIGAASLAQVHLATIKETGQRVAVKRWAPLDMRLTSTTFKTLKYFFPEYDLEWLSSEVEISLPKELDFTCEAENARRTSRYFAEFAPSLPLVIPDVLWAKKRLLVMACESGHRLDDLAYMDAYGIDRDEVSATLARIFNEMIFGEGAPLHCDPHGGNIAIRYHDNSNKSKSKSNFDIILYDHGLYRDIPLPLRRSYAKLWLAIIDGDIPKMKRYVHEVAGIGEDKFPLFASAITGRDFINVVSATDSGGVLKPKEASEQKSMSTALQEGLIVDLVQMLGQVPRIILLILKTNDLTRALDESLHTKQGPVRQFLILARYCMRTVFYEQLEEIRGLGSIWSPANLVRLVGAWWGMARVEVKLEVFELWLRVKRTLGLGSGFGMGMGTGEEAQQQVVPVGKKGQKRLEREVEAAAAVSVAAAAAAA

SEQ ID NO: 21164 - protein, 406 aa, Clostridium perfringens str. 13
MKKFIALEEALEILNKNTKALKSEVVSIKDSLKRVLYGDVKSKINNPPFNKSVFDGYAFKSEDSKGTSKENPIELKIVDEIFAGMWPEIEIKHGEAIRIMTGAPIPMGADCVLKQEETERHGDLVKIFKEMKSYENISFMGEDIKIGETLIKKGKRLDYADLGIMASSGISEVLVYKKPRVSIISTGDEVCDINSTLKPGKIYDSNLYSLSARIEELGYNVLSMEHVGDNILKIGEAIEKAFEKSDIVFTTGGASVGEKDLMQKVSESIGFEKLFWKIKIKPGSAVVCSKKEEKILISLSGNPNAALTTFELLGKPVLKKLEGEEENINIKREKGVLMDSFNKKSPQRRFLRGNVIYDEKGTKVYITQIKSGNGILSSLLNANCLIEIEKGNEGLNRGEVVNIIKL

SEQ ID NO: 21165 - protein, 497 aa, Glycine max
MAPSSTLTLSKVSLFLVLLFFVSLSSSYATSRLTHDRVNNPPKSRAEKLIRSLNLSPKDPVNIVKGDDLANGFVPGNIVEKKFSFLGDSGPSIEDLGHHAGYYSLPNSKAARMFYFFFESRSNKDDPVVIWLTGGPGCGGELALFYENGPFHIANNLSLVWNDFGWDQASNILFVDQPTGTGFSYSSDASDIRNDEVGISNDLYDFLQEFFKAHPEFVKNDFYITGESYAGHYVPALASRVNQGNKENEGIHINLKGFAIGNGLTNPAIQYQAYPDFALDNGIITKAEHDQISQSIPDCEQAAKTCETQGGQSCETAFNICDSIFNSIMTIAGDINYYDIRKKCVGELCYDLKDVETLLNLQNVKSALGVAEDLTYVSCSTTVYNAMGQDWMKNLEVGIPSLLEDGIKLLVYAGEEDLICNWLGNSRWVYAMEWSGQKTFGTSPTVKFVVDGAEAGSLNSYGPLSFLKVYEAGHLVPMDQPKAALQMFKSWMGGNLI

SEQ ID NO: 21166 - protein, 319 aa, Glycine max
MLIVFICIFLFFIFLYKFLIAYGDFTLMSKKQPKRQEIEDKVVWITGASRGIGEILAKQFASLGAKLIISARNEAELNRVRTQLKGKHAPDDVKILPLDLSSGEDSLRIAVEKAESFFPDSGVDYMVHNAAFERPKTSILDVTEEGLKATFDVNVLGTITLTKLLAPFMLKRGHGHFVVMSSAAGKTPAPGQAVYSASKYALNGYFHTLRSELCQKGIQVTVVCPGPIETSNNAGSRVPSEKRVPSERCAELTIIAATHGLKEAWISYQPVLAVMYLVQYMPTIGYWVMDKIGKSRVEAAEQKGNTYSLSLLLGKKKAT

SEQ ID NO: 21167 - protein, 465 aa, Bradyrhizobium japonicum
MRLAFVFAREGVFGSVDPSLVPPPGQLALKLARIVERRGPKHGPRLSRALTRMGPAYLKLGQFLATRPDVVGVIMARDLESLQDRLPPFSQAEAEAAIAASLERPLKDVFASLGPPVAAASIAQVHRGEVVRDGIRKAVAVKVLRPNVASRFRRDLSDFFYVAHKAETYSAEARRLRLIEVINTMSRSVAMEMDLRLEAAAMSEMAENTGDDLDFRVPTVDWDRTTHNVLTMEWIDGIALNDHKRLAEAQVDLPDLGRKVIQSFLRHALRDGFFHADMHPGNLFLDDTGRLVAVDFGIMGRLGMKERRFLAEILLGFITRDYRRVAEVHFEAGYVPVHHSVENFGASAIRAIGEPIHNRTAEEISMARLLTCCSRSPDLFDMTTRPELILLQKTMVVVEGVARGFDPRLDIWKTADPVVREWIERNLGPIGGCRARSPAAATSPRADAPARYRAAPLQCSSSSRP

SEQ ID NO: 21168 - protein, 269 aa, Glycine max
  unsure (1)..(269): unsure at all Xaa locations
MAEQALEGSQPVDLTKHPSGIVPTLQNIVSTVSLDCKLELKSIALQARNAEYNPKRFAAVIMRIREPKTTALIFASGKMSXHYEGSHPSPLTNTFFLRASVHSLTKTNRFIKLLHLLVMGFYFLCFFPSKFKSHGXVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAXRDETYTAFENIYPVLTEFRKNQQWGSGSFSAIGYTC

SEQ ID NO: 21169 - protein, 181 aa, Triticum aestivum
  unsure (1)..(181): unsure at all Xaa locations
MAPTVMASSATSVAPFQGLKSTAGLPVSXRRFSNGASLGSVSNGGRIRCMQVWPIEGIKKFETLSYLPPLSTEGPLLKQGSXPLIRSQWVPCLEFSKGGVHSSREHNAFSGYYDGXRYWDNVELPMFGCTDATXVINXVEESRRIPDPYVRIXXSTTCSRECVNLTLQATGARSGKAKSHH

SEQ ID NO: 21170 - protein, 187 aa, Triticum aestivum
  unsure (1)..(187): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQXCVSFIAFKPPGCEESGKGLKQAQLTTGQI

SEQ ID NO: 21171 - protein, 282 aa, Escherichia coli
ALLLKTQLPSGSELSLYDIAPVTPGVAVDLSHIPTAVKIKGFSGEDATPALEGANVLLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 21172 - protein, 278 aa, Cladonia arbuscula
VEHGAVKVVAVNDPFIEPHYAAYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDDFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGDLKGIMAYSEDDLVSTDLNGDNHSCIFDAKAG

SEQ ID NO: 21173 - protein, 104 aa, Glycine max
MSATQEEDKKPGEQGGVHINLKVKGQDGNEVFFKIKRSTQLKKLMNAYCDRQSVDLNAIAFLFDGRRLRAEQTPDELDMEDGDEIDAMLHQTGGVANGMYLFCF

SEQ ID NO: 21174 - protein, 261 aa, Streptomyces coelicolor
MTVMEQRGAYRPTPPPAWQPRTDPAPLLPDTEPYRVLGTKAADRADTELLRTLYARLVRGRRYNAQATALTKQGRLAVYPSSTGQEACEIAAALALEERDWLFPSYRDTLAVVSRGVDPVEALTLLRGDWHTGYDPYEHRVAPLSTPLATQLPHAVGLAHAARLKGDDVVALAMVGDGGTSEGDFHEALNFAAVWRAPVVFLVQNNGFAISVPLDKQTAAPSLAHKAVGYGMPGRLVDGNDAAAVHEVLSDAVRHARAGGG

SEQ ID NO: 21175 - protein, 128 aa, Triticum aestivum
  unsure (1)..(128): unsure at all Xaa locations
VRALVLVLRDVGQHSLTLTRQPLWRPVHEAPSYTLDAYKHSXTSGANAGYWTTNSDAPVWNNNNALTVGQRGPILLEDYHLIEKLAQFDRERIPERCVHARGASAKGFFXEVTHDVSQLTCADFLRAP

SEQ ID NO: 21176 - protein, 478 aa, Agrobacterium tumefaciens str. C58
MHTYPDIKLLIDGEWRDAVSGKTIAVSDPATDEIIGAIAHAEKEDLDLALAAAERGFKLWRDTSPYERSKIMRKAADILRERKDKIAYIMTREQGKPLAQSATEIMGAADTIDWFAEEARRTYGQVIPARATGVSQLAIKVPVGPVAAFTPWNFPLNQIVRKLSAALATGCSIIVKAPEETPASPAELIRAFVDAGVPAGVIGLVYGVPSEISEYLIPHPVIRKISFTGSTPIGKHLAALAGKHMKRATMELGGHAPVMIFDDADIEKAIEVTSLAKFRNAGQVCVAPTRFLVQDGVADRFLEGFVEATKAIKVGNGLEEGVIMGPLANERRIPALEGLINDAVSHGAELKTGGRRIGNKGNFFEPTVLANVPVTAKIMNDEPFGPVAIINRFSSFDDAITEANRLPFGLASYAFTGSVKTAHALGQQVEAGMLTINHNGLALPEVPFGGIKDSGYGTEGGSEAVQAYLETKFVSQMS

SEQ ID NO: 21177 - protein, 485 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNEVTFSVLFLYHYDHSSFKIETFSIILQCRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMVKSFTKSCPDYNHGCSALYVDDHYCVLQEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 21178 - protein, 167 aa, Amorphophallus albus
GTADAVRQFIWVFEDPRNKNIEHVLILSGDQLYRMDYMDLVQRHMDTRADITVSCVPVDDSRASDFGLMKIDKVGRIVHFSEKPKGSVLDAMKVDTTIPGLSPYEAKNFPYIASMGVYAFRTEILLNLLRWRYPTSNDFGSEIIPSAVNEYNVQAYLFKDYWEDIGT

SEQ ID NO: 21179 - protein, 417 aa, Streptomyces avermitilis MA-4680
MEHITLLLGIVIVTALVFDFTNGFHDTANAMATTISTGALKPKTAVAMSAVLNLVGAFLSVEVAKTISGGIINEEGIRVEVIFAALVGAILWNLLTWLLGLPSSSSHALFGGLIGAAVMSAGWSSVNGPTIVTKILIPAVAAPVVAGIAAMLATRLTYRIGARADEKATKKGYRAGQIASAGLVSLAHGTNDAQKTMGIITLALVTGGVVAPGSNPPMWVIVSAGTAIALGTYLGGWRIIRTMGKGLTDLAPPQGFAAQTSAATAILASSHIGFSLSTTQVCSGSVLGAGIGRKGGVVRWSTATRMFAAWGLTLPAAGLVGAGAELLTKQGTWGTIATGVLLVAGAGAIWALSRRQPVTVDNVNDIAAEPAGVVTTAIAAVTPPPAGPVSVVDATADLKTTIPAPSPGAEPTRPATV

SEQ ID NO: 21180 - protein, 627 aa, Cytophaga hutchinsonii
MENRIYIVMGVSGCGKTTIGTLLAETLGINFYDGDAFHPISNIEKMAAGIPLTDEDRYNWLLDINKQAKESLSEGHSVVFACSALKESYRKLLAQQIEDTIVWIYLKGDLDTIHLRVKNRTGHFMSPALLQSQFNILEEPSSAMHIDTALDTDTIIHTIVKKLTKSAFGLVGLGVMGKSLARNFAANGVALSLYNRFVKGSEEQVAEKCIAEYPELQSAKGFEDLKTFAASLEQPRKIFLMIKAGEETDTFIEELVPYLNAGDVLIDGGNSYYGDTKRRIEFLARKGIYFIGTGVSGGEQGALKGPSIMPSGDPDAYALVEKYLTLIAAKDKQGESCCTYIGKDGSGHFVKMIHNGIEYAEMQLIAEVYAYLRYAIKIEPTEIAALFTEWNSGELNSYLLGITAALLIKKEGDAWLIDLILDKAGNKGTGNWATIAASELGQPATLITSALFARYVSTIKEHILVNTQPASVYHFNTAALSEIKDAYMLARIVNHQQGFMLIHEASQKYGWDLNFAEIARIWTNGCIIRSAFMEELIPALKKDSNIFTHPAILKQLKDLKPALKAFAVNALQYDLSVPSHLAALDYLNVLSGNYATANIIQAQRDFFGAHTYQKIGDSSGKYYHTEW

SEQ ID NO: 21181 - protein, 80 aa, Zea mays
  unsure (1)..(80): unsure at all Xaa locations
MRAPSKLRIFENMQDLYETVKKAPMGRQVRCCSTCRRYLAATEIDGYCQGELIKGTLSGXHDPIRGAITQAAMDLGVVQL

SEQ ID NO: 21182 - protein, 172 aa, Oryza sativa
GFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 21183 - protein, 387 aa, Glycine max; identical to SEQ ID NO: 4377

SEQ ID NO: 21184 - protein, 469 aa, Arabidopsis thaliana
MGSKSVVDMIEAASRAHFSGLHVNGHMNGLEPSALKETTSASEDIQRQPFVIGVAGGAASGKTTVCDMIIQQLHDQRVVLINLDSFYHNLTEEELARVHEYNFDHPDAFDTEHLLSCMEKLRQGQAVDIPKYDFKTYRSSVFRRVNPTDVIILEGILLFHDPRVRKLMNMKIFVCTDADVRLARRIKRDTVENGRDIGTVLDQYSKFVKPAFDDFILPTKKYADIIIPRGGDNHVAIDLIVQHICTKLGQHDLCKIYPNLYVIHSTFQIRGMHTLIRDSQTTKHDFVFYSDRLIRLVVEHGLGHLPFTEKQVITPTGCVYSGVDFCKRLCGVSVIRSGESMENALRACCKGIKIGKILIHREGDNGQQLVYEKLPNDISERHVLLLDPILGTGNSAVEAINLLISKGVPEGNIIFLNLISAPQGVHVVCKKFPRIKIVTSEIDNGLNEEFRVIPGMGEFGDRYFGTDDD

SEQ ID NO: 21185 - protein, 483 aa, Brucella melitensis 16M
MDMQEELMYPNLTLIVGGEERNKGSAGTLCLTDPADGRELTIAPRAGRAEALQAAAAEKGFAEWSALSALERSKIMRRAADIMRERADAAARIMSMEQGKPLSEARGEWLGSADLLDWFAEEGRRVYGRIVPSRAPNIQIQVLKHPIGPVAAFTPWNFPAWNTMQKVAPALGAGCSVVIKPASDTPGTAWLIGKCLLEAGLPPKAVSVIWGTTSELSDALIKAPEIRKVSLTGSTRVGRIVAAQAGEYLKKVTMELGGHGPVIVAADADLDHLIPLAVQWKFRNCGQVCVSPTRFIVEASIHDEFIRRFSEKARELKVGKGVEEGAQMGPLTSQNQLETVLSMVEDALTKGAKIETGGNRIGDTGNFYEPTILSGMTAEMLAMNEEPFGPLALVMRVHSLDEAIAESNRLPVGLGAYLFTSSMTTAHRVQNHLQAGMLGVNHFALALPETPFGGVRDSGFGSEGGLEGIEAYLTTMTVTTMMV

SEQ ID NO: 21186 - protein, 659 aa, Gossypium hirsutum
MAAATANSALPKLSTLTSSFKSSIPISKSSLPFSTTPQKPTPYRSFDVSCSLSHASSNPRSAATSVTPKNAPPHDFISRYADDEPRKGADILVEALVREGVKDVFAYPGGASMEIHQALTRSKIIRNVLPRHEQGGVFAAEGYARSSGIPGVCIATSGPGATNLVSGLADAMLDSIPLVAITGQVPRRMIGTDAFQETPIVEVTRSITKHNYLVLDVDDIPRIVSEAFFLASSGRPGPVLIDVPKDIQQQLAVPKWNHSLRLPGYLSRLPKAPGEAHLEQIVRLVSESKKPVLYVGGGCLNSSEELKRFVELTGIPVASTLMGLGAFPISDDLSLQMLGMHGTVYANYAVDKSDLLLAFGVRFDDRVTGKLEAFASRAKIVHIDIDSAEIGKNKQPHVSVCSDVKLALQGINKILETKVAKLNLDYSEWRQELNEQKLKFPLSYKTFGEAIPPQYAIQVLDELTGGNAIISTGVGQHQMWAAQFYKYKKPRQWLTSGGLGAMGFGLPAAIGAAVANPEAVVVDIDGDGSFIMNVQELATIRVENLPVKILLLNNQHLGMVVQWEDRFYKANRAHTYLGDPSNESEIFPNMLKFAEACGIPAARVTKKEDLKAAMQKMLDTPGPYLLDVIVPHQEHVLPMIPSGGAFKDVITEGDGRTQY

SEQ ID NO: 21187 - protein, 757 aa, Bifidobacterium longum DJO10A
MSESTYPSVKDLTLEEKASLTSGGDAWHLQGVESKGIPGYMITDGPHGLRKSLASSAGETDLDDSVPATCFPPAAGLSSSWNPELIHKVGEAMAEECIQEKVAVILGPGVNIKRNPLGGRCFEYWSEDPYLAGHEAIGIVEGVQSKGVGTSLKHFAANNQESDRLRVDARISPRALREIYFPAFEHIVKKAQPWTIMCSYNRINGVHSAQNHWLLTDVLRDEWGFEGIVMSDWGADHDRGASLNAGLNLEMPPSYTDDQIVYAVRDGRITPAQLDRMAQGMIDLVNKTRAAMSIDNYRFDVDAHDEVAHQAAIESIVMLKNDDAILPLNAGPVANPSAMPQKIAVIGEFARTPRYQGGGSSHITPTKMTSFLDTLAERGIKADFAPGFTLDLEPVDPALESEAVETAKNADVVLMFLGLPEAAESEGFDRDTLDMPAKQITLLEQVAAANQNVVVVLSNGSVITVAPWAKNAKGILESWLLGQSGGPALADVIFGQVSPSGKLAQSIPLDINDDPSMLNWPGEEGHVDYGEGVFVGYRYYDTYGKAVDYPFGYGLSYATFEITGVAVAKTGANTATVNATVTNTSDVDAAETVQVYVVPGKADVARPKHELKGFTKVFLKAGESKTVTIDLDERAFAYWSEKYNDWHVEAGEYAIEVGVSSRDIADTVAVALDGDGKTQPLTEWSTYGEWEADPFGAKIVAAVAAAGEAGELPKLPDNAMMRMFLNSMPINSLPTLLGEGGKKIAQFMVDEYAKLSK

SEQ ID NO: 21188 - protein, 573 aa, Streptomyces clavuligerus
MSRVSTAPSGKPTAAHALLSRLRDHGVGKVFGVVGREAASILFDEVEGIDFVLTRHEFTAGVAADVLARITGRPQACWATLGPGMTNLSTGIATSVLDRSPVIALAAQSESHDIFPNDTHQCLDSVAIVAPMSKYAVELQRPHEITDLVDSAVNAAMTEPVGPSFISLPVDLLGSSEGIDTTVPNPPANTPAKPVGVVADGWQKAADQAAALLAEAKHPVLVVGAAAIRSGAVPAIRALAERLNIPVITTYIAKGVLPVGHELNYGAVTGYMDGILNFPALQTMFAPVDLVLTVGYDYAEDLRPSMWQKGIEKKTVRISPTVNPIPRVYRPDVDVVTDVLAFVEHFETATASFGAKQRHDIEPLRARIAEFLADPETYEDGMRVHQVIDSMNTVMEEAAEPGEGTIVSDIGFFRHYGVLFARADQPFGFLTSAGCSSFGYGIPAAIGAQMARPDQPTFLIAGDGGFHSNSSDLETIARLNLPIVTVVVNNDTNGLIELYQNIGHHRSHDPAVKFGGVDFVALAEANGVDATRATNREELLAALRKGAELGRPFLIEVPVNYDFQPGGFGALSI

SEQ ID NO: 21189 - protein, 244 aa, Zea mays
MGRGRVELKRIENKINRQVTFAKRRNGLLKKAYELSVLCDAEVALIIFSNRGKLYEFCSGQSITKTLERYEKNSYGGPDTAVQNKENELVQSSRNEYLKLKARVDNLQRTQRNLLGEDLGSLGVKELDQLEKQIDSSLSHIRSTRTQHMLDQLTDLQRREQMMCEANKCLRRKLEETSNQVHGQVWEHGANLLLGYERHSSPQQAPSHVGNGLFFHPLEAAAEPTLQIGFAPEHMNNFMPAWLP

SEQ ID NO: 21190 - protein, 370 aa, Bradyrhizobium japonicum USDA 110
MATHKLLLLPGDGIGPEVMGEVKRLIDWLNSAGIAKFETDTGLVGGSAYDAHKVSISEGDMAKALAADAIIFGAVGGPKWDAVPYEVRPEAGLLRLRKDLGLFANLRPAVCYPALADASSLKREAVEGLDIMIVRELTGGVYFGEPKTITDLGNGQKRAIDTQVYDTYEIERIARVAFDLAKKRKNKVTSMEKRNVMKSGVLWNEVVTQVHKREYPDVTLEHQLADSGGMMLVKWPKQFDVIVTDNLFGDMLSDIAAMLTGSLGMLPSASLGEVDVKSKKRKALYEPVHGSAPDIAGKGLANPIAMISSFGMALRYSFDMGALADKVDAAIAAVLASGLRTADIKSEGTTAASTTQMGEAILKELQKLHA

SEQ ID NO: 21191 - protein, 186 aa, haloarchaeal coccus LOC-1
MSTLTDTIHIENVVASSTLGAELALEQLAADLPGADYNPEEFPGVIYRLDDPPSTTLIFDSGKAVCTGAQTVDDVHEALSIVVEDLRELGIDIAADPPVDVQNIVCSADLDQPLNLNAIAIGLGLEAIEYEPEQFPGLVYRLDDPDVVVLLFGSGKLVITGGSDPDDATVALEDVHDRLTDLGLLE

SEQ ID NO: 21192 - protein, 114 aa, Triticum aestivum
  unsure (1)..(114): unsure at all Xaa locations
VAIGCTKSDYFLDFRCATQPLTVMLPRYNDHPLTLCYGEEKASGKYWCDICERESNPKTWLHTXCKELWRSHLHVFCVVGDVIYTNPGAMIKCYIEKLSNNSSSRPLCHRCHCR

SEQ ID NO: 21193 - protein, 65 aa, Nostoc punctiforme
MILPGATVRVKNPADTYYRYEGLVQRLTDGKVAVLFEGGNWDKLVTFRLSELELVETIAGRKKAK

SEQ ID NO: 21194 - protein, 896 aa, Xanthomonas campestris pv. campestris str. ATCC 33913
MHSHPAPHARVPHRALARGLLLALGVAAGSTHAATPPPPYLDPTQPLQARAADLVSRMTLEEKAAQMQNAAPAIPRLQVPEYDWWNEALHGVARAGGATVFPQAIGLAATFDTPLMAEVATAISDEARAKHHAFLAGGEHKRYQGLTFWSPNINIFRDPRWGRGQETYGEDPFLTARMGVTFVQGLQAQQGPYRKLDATAKHYAVHSGPEADRHHFDVHPSERDLYETYLPAFQALVQEGHVAAVMGAYNRVNGESASASTRLEGILRRDWGFDGYIVSDCAAIRDIWQNHKIVPTPEAAAALGVKHGTDLDCGDTYAALPAAVRAGLIDEATIDRSLTRLMAARLRLGMFDPPAKVPWAQTPASANQSPQHDALARRTARESLVLLKNDGLLPLKPTLKRIAVVGPTADDPMSLLGNYYGTPAAPVTILQGIRDAAPQAEVVYARGSDLVEGREDPNAAAPIDARYLRPAAGASQNGLTGDYFRGRALAGQPVLTRIDPRIAFRWDRNAPTDDAVGRGELQPGQALGKDDFSVRWHGQLLPPVSGNYELQIAADDGVRLYLDGKPLIDQWSDAPRMRSSTATVALQAGKAYDLRVEYYEATRDAGVRLAWRMPGAKPPLQEAVDAARNADVVVFVGGLTGDVEGEEMDVNYPGFAGGDRTDTRLPKPQRELLQALQATGTPVVAVLTTGSALAIDWAQQHVPAILLAWYPGQRGGTAVGDVLFGQASPGGRLPITFYKEDERLPAFDDYAMRGRTYRYFDGKPLYPFGHGLAYTQFAYSNLRLDRTTVAADGTLRATVSVKNTGQRAGDEVVQLYLHPLNPQRERARKELRGFQRITLQPGEHREVSFNITPREALRIYDEQRKAYAVDPGAYELQIGASSADIRSKQRFTVTAN

SEQ ID NO: 21195 - protein, 184 aa, Hordeum vulgare
KYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNSYYDMNARI

SEQ ID NO: 21196 - protein, 196 aa, Mitthyridium sp. Wall 2495
GGAKKVVISAPSKDAPMFVMGVNEEKYTNEDIVSNASCTTNCLAPLAKVINDKFGILEGLMTTVHATTATQKTVDGPSNKDWRGGRSAGSNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDTFVKL

SEQ ID NO: 21197 - protein, 203 aa, Zea mays
QLAVSSHDWESAKGLVGMADAQGLNDVLCVAVDAIWFLSDRDELLAIVGLIKRVVSEGAKDFTRAALRTSFLASCVSACRGRSTSLADAVSFMGQKLHERLQESQGDEVLKAEASAKVHRFTEWALKCIGLHSRVRENRGKGNHDTVIEVQLQLSAFKIFLDLADNELTGKDFTEAFDAACFPLTLFSTTFDQGWASGISAAA

SEQ ID NO: 21198 - protein, 1000 aa, Vicia faba
MTMRFHPNSTAVTESVPRRGSVYGFIGYRSSSLFVRTNVIKYRSVKRNLEFRRRSAFSVKCGSGNEAKQKVKDQEVQQEAKTSPSSFAPDTTSIVSSIKYHAEFTPLFSPEKFELPQAFIATAQSVRDALIINWNATYDYYEKLNVKQAYYLSMEFLQGRALLNAIGNLELTGPYAEALSQLSYKLEDVAHQEPDAALGNGGLGRLASCFLDSLATLNYPAWGYGLRYKYGLFKQRITKDGQEEVAEDWLEMGNPWEIVRNDVSYPVRFYGKVVSGSDGKKHWVGGEDIKAVAHDVPIPGYKTRSTINLRLWSTKAASEEFDLNAFNSGRHTEASEALANAEKICYILYPGDESIEGKTLRLKQQYTLCSASLQDIIARFERRSGASVNWEDFPEKVAVQMNDTHPTLCIPELMRILIDIKGLSWKDAWNITQRTVAYTNHTVLPEALEKWSMDLMEKLLPRHVEIIEMIDEELIRTIIAEYGTADSDLLDKKLKEMRILENVELPAEFADILVKTKEATDISSEEVQISKEGGEEEETSKEGGEEEEEKEVGGGREEGDDGKEDEVEKAIAEKDGTVKSSIGDKKKKLPEPVPVPPKLVRMANLCVVGGHAVNGVAEIHSEIVKDDVFNAFYKLWPEKFQNKTNGVTPRRWIRFCNPDLSKIITQWIGTEDWILNTEKLAELRKFADNEDLQTQWREAKRNNKVKVAAFLRERTGYSVSPDSMFDIQVKRIHEYKRQLLNIFGIVYRYKKMKEMNAAERKENFVPRVCIFGGKAFATYVQAKRIVKFITDVGATVNHDPEIGDLLKVIFVPDYNVSVAEMLIPASELSQHISTAGMEASGTSNMKFAMNGCLQIGTLDGANVEIREEVGADNFFLFGAKAREIVGLRKERARGKFVPDPRFEEVKKFVRSGVFGSYNYDELIGSLEGNEGFGRADYFLVGQDFPSYLECQEEVDKAYRDQKKWTRMSILNTAGSSKFSSDRTIHEYAREIWNIEPVKLE

SEQ ID NO: 21199 - protein, 370 aa, Bacillus anthracis str. A2012
MRVKEQLLTLRAYVPGKNIEEVKREYGLSKIVKLASNENPFGCSARVTEALTSLASQYALYPDGHAFELRTQVAKHLGVKAEQLLFGSGLDEVIQMISRALLHEGTNVVMANPTFSQYHHHAVIEGAEVREVSLKDGIHDLDAMLQQVDDQTKIVWICNPNNPTGTYVEKQKLLSFLESVPKSALVIMDEAYYEYAGAEDYPQTLPLLEKYENLMVLRTFSKAYGLAAFRIGYAVGNTELIGQLEVARLPFNTSTVAQSVALAALEDQAFLQECVKKNEEGLHQYYAFCKEYNVFYYPSQTNFIFLKLGIPGNEAFERLMKKGYIVRSGAAFGIDDGIRITVGLKEENDEIIELLKELVNEQVQKEETYS

SEQ ID NO: 21200 - protein, 400 aa, Arxula adeninivorans
  unsure (1)..(400): unsure at all Xaa locations
MADFIRTQIFGTCFEITSRYVDLNPVGMGAFGLVCSARDQLTNQNVAIKKIMKPFSTPVLAKRTYRELKLLKHLRHENLITLSDIFISPLEDIYFVTELLGTDLHRLLTSRPLEHQFIQYFLYQILRGLKYVHSAGVVHRDLKPSNILINENCDLKICDFGLARIQDPQMTGYVSTRYYRAPEIMLTWQKYDVEVDIWSAGCIFAEMLRGKPLFPGKDHVHQFSIITELLGNPPDDVIETIGSENTLNFVKSLPKRERIPLSQKFPNADPDAVDLLEKMLVFDPRKRINAADALAHPYLAPYHEPSDEPVASEKFDWSFNDADLPVDTWKVMMYSEILDFHNVDSSAVEQQQQQPQPPQPQLQQQQQPPQQPQQPQQPQXAQQPVQPVQGDYVPQVAPRS

SEQ ID NO: 21201 - protein, 617 aa, Mucor circinelloides
  unsure (1)..(617): unsure at all Xaa locations
MLSLKRIATTTKSNIFHRALLAQRSYSYINANEYSDPRHDKNVHVMHSRGVNLLHDPLLSKGTAFSIAERERLSIRGLVPPRCQEMDKQLLRIKRNLDACETPLAKFVFLAALHDRNETLYYKIIMEHLEELAGIIYTPTVGLASQMSHSIYRRSRGMYFSSQDRGQMSAMVYNWPHDKVDVIVVTDGSRVLGLGDLGANGMEIPIGKLSLYVAAGGIRPRAVLPVVLDVGTNNQDLLNDPLYLGMSHPRLEGEEYYSFIDEWVTAITSRWPDTLIQFEDFKYPHAYNLLAKYRNRITCFNDDIQSTSSITLAGILASLKSRGMSQEDLSNERIICVGAGSAGVGVCEGIIDCMVAQGRVKSREEAYSKIYMLDQYGLLGNPGVHLPSDEEHGHPYQPRTTKLDDRQYCYVKHDLRDQMGLEELVRKVKPTVLLGLTGIQGVXSEEAVREMAKHHERPVIFPLSNPDTHAECTAEEAFKWTDGRAIFASGSPFKDVELPNGKIGRTNQCNNSYSFPVSGLGXGITVSRASRVTPNMFLETARTIADMATPSQLKEGILFPGVSQLREVALNVGTRVCEVAFEEGYATAKLEEGEILSEVVRSSAYQPEYVPLVYRDH

SEQ ID NO: 21202 - protein, 757 aa, Glycyrrhiza glabra
MWKLKIAEGGSPWLRTVNNHVGRQVWEFDPKLGSPEDLLEIEKARQNFHDNRFTHKHSADLLMRIHFAKENPMNEVLPKVRVKDIEDVTEETVKTTLRRAINFHSTLQSHDGHWPGDYGGPMFLMPGLVITLSITGALNAVLTEEHRKEICRYLYNHQNKDGGWGLHIEGPSTMFGSVLNYVALRLLGEGPNDRQGEMEKGRDWILGHGGATFITSWGKMWLSVLGVYEWSGNNPLPPEIWLLPYVLPIHPGRMWCHCRMVYLPMSYLYGKRFVGPITPTILSLRKELYTIPYHDIDWNQARNLCAKEDLYYPHPLVQDILWASLHKFLEPILMHWPGKKLREMAIKTAIEHIHYEDDNTRYLCIGPVNKVLNMLCCWVEDPNSEAFKLHLPRIYDYLWIAEDGMKMQGYNGSQLWDTAFTAQAIISSNLIEEYGPTLRKAHTYIKNSQVLEDCPGDLSKWYRHISKGAWPFSTADHGWPISDCTAEGLKAVLLLSKIAPEIVGEPLDAKRLYDAVNVILSLQNEDGGFATYELTRSYTWLELINPAETFGDIVIDYPYVECTSAAIQALTSFKKLYPGHRREEIQCCIEKAASFIEKTQASDGSWYGSWGVCFTYGTWFGVKGLIAAGKSFNNCSSIRKACEFLLSKQLPSGGWGESYLSCQNKVYSNVESNRSHVVNTGWAMLALIDAEQAKRDPTPLHRAAVYLINSQMENGDFPQQEIMGVFNKNCMITYAAYRNVFPIWALGEYRHRVLQSQ

SEQ ID NO: 21203 - protein, 342 aa, Methanosarcina mazei Goe1
MTKTAAVIKGDGVGPELVDAMLKVAEASGTDVEFVMCEAGAGWWEEHGGNSLIPEETWQILDSSDACFKGPTTTPGGIGSPRSVAVSIRRKYDLYANVRPIKTFPNSSAPLGDVEMVCVREGTEGLYIGEEIQLTDDVSIAIRKITRTASSKIARYAFEDAKKRGYDTVVPIHKSNILKLTCGSFLEEVEKVAHDFPDIEVWPYHIDNIAQQLIKNPQIFNKKVLLSTNLFMDVISEECSALVGSIGLIYSANIGDNFAMFEPAHGSAPKYAGLDKVNPVATVLAGAWMLDYLGEKDKSDAIFKATERVISEGKYVTYDLGGSAKLSQMADEIAKYTEEILK

SEQ ID NO: 21204 - protein, 465 aa, Myriogramme livida
AKMGYWDPAYVIKETDVLALFRVTPQPGVDPVEASAAVAGESSTATWTVVWTDLLTACDLYRAKAYKVDKVPNTSDQYFAYISYDIDLFEEGSIANLTASIIGNVFGFKAVRALRLEDMRIPVAYLKTFQGPATGIIVERERMDKFGRPFLGATVKPKLGLSGKNYGRVVYEGLRGGLDFLKDDENINSQPFMRWKERFLYSMEAVNRSIAATGEIKGHYMNVTASTMEDMYERAEFAKALGTVIIMIDLVIGYTAIQSMAIWSRKNDMILHLHRAGNSTYSRQKIHGMNFRVICKWMRMAGVDHIHAGTVVGKLEGDPLMIKGFYNTLLLSNLEVNLPQGIFFKQDWASLRKVTPVASGGIHCGQMHQLLDYLGNDVVLQFGGGTIGHPDGIQAGATANRVALESMVIARNEGIDFVTEGPQILRDAAKTCGPLQTALDLWKDITFNYTSTDTPDFVETPTANV

SEQ ID NO: 21205 - protein, 257 aa, Novosphingobium aromaticivorans
MECLLKTTSSVRFGSIHHPCECPANEACPFSIMSLFKRKAASSLETLALAKVGETVRKRLSADPGVYRIPLDDLEIFGVADFFSAEECAKLMAIVDSVARPSPTYSGTDASGRTSYTGDVDPFDPFVLMLQRRIDDLMGIDPSFGETIQGQRYAPGQEFRGHYDHFLPSQPFWDAEQKRGGQRSWTAMAYLNAVEEGGQTEFARVNLSIPPQPGALLIWNNMKPDGTPNANAMHAGMPVVRGTKYVLTKWYRSRPWH

SEQ ID NO: 21206 - protein, 94 aa, Triticum aestivum
  unsure (1)..(94): unsure at all Xaa locations
QLRPTSSFHTKTTTTNSRQAVWNDYXWLTTSRWRRMLIXDYNALENIWHLPRERMPKRVVHARSTSPKGSVESTYERRGLTCAELLRSPGACTS

SEQ ID NO: 21207 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPLRWEGHSPRAGTFL

SEQ ID NO: 21208 - protein, 335 aa, Cytophaga hutchinsonii
MSKIKVGINGFGRIGRLVFRAAVNNPNIQIVGINDLIDVDYMAYMLKYDSTHGRFSGTVDVTDGKLVVNGNAIRVTAERDPANLKWNEVGAEYVVESTGLFLTMDTADKHIAAGAKRVVLSAPAKDDTPTFVMGVNNKSYTKDMTIVSNASCTTNCLAPVAKVLNDNFGILEGLMTTVHAATATQKTVDGPSAKDWRGGRGAYQNIIPSSTGAAKAVGLVIPQLKGKLTGMSFRVPTPDVSVVDLTCRLEKAASYETIKAAMKAASEGDMKGILGYTEDEVVSTDFLGDARTSIFDAKAGISLNDNFVKVVSWYDNEWGYSNKLVDLIVHMDTVK

SEQ ID NO: 21209 - protein, 262 aa, Enterococcus faecalis V583
MDLTNKVVVVTGGSAGLGEQICYEAAKQGAVVVVCARRINLIGKVREQCAVLSGREAFSYQLDIADPESVERVVEAISAEVGPIDVLVNNAGFGLFENFVEIDLAVARQMFDVNVLGMMTFTQKVAIKMIEAGQGHIINVASMAGKMATAKSTVYSATKFAVLGFSNALRLELKPLGVAVTTVNPGPIQTEFFDKADPTGTYLAAVDKIVLDPTKLAKEVVGSMGTSRREINRPFVMEAAARFYTLFPHLGDFIAGNILNKK

SEQ ID NO: 21210 - protein, 488 aa, Gelidium floridanum
MSNSVEERTRIKNQRYESGVIPYAKMGYWDPNYAIKETDVLALFRITPQPGVDPVEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIIMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVEEGPQILRDAAKTCGPLQTALDLWKDISFNYTSTDTADFVETPTANV

SEQ ID NO: 21211 - protein, 365 aa, Paracoccidioides brasiliensis
MGLLVKDLLSRKTGVIVGDDVLRLFQHAQENVFAIPAIMVTSSSTGSALEAARDKSPIVLQTSNGAAYFAGKGKGVSNDGQSVAGSIAIAAAHYIRSQAPAYGIPVVLHTDHCAKKLLPWLDGMLDADECYSKLHNEPLFSSHMIDLSEESVEWNIETTAKYLKRAAPMKQWLEMEIGITGGEEDGVNNESVDNNSLYTQPEDIYTIYKTLSAISPYFSIAAGFGNVHGVYRGDIALRPLLRHLHNAKYDEQLKCLQDPLGFFVFHGGSGSSHQPATSITSEFAAKGRVDLEKVAYLPGTSSLVIAPKDYLMSPYGIPVVLHTDHCKYFDPRVQIREGLKHMSARVQEAKDDFNDSNQAKKLLPW

SEQ ID NO: 21212 - protein, 427 aa, Coxiella burnetii
MTELTGVSIVTYQHIKVPSQGEKITVNKAVLEVPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 21213 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 21214 - protein, 483 aa, Ralstonia metallidurans
MTATRPDLPKHDLLIDGKRLPPGSGEYSTDINPATEEPIALVAQGSAADVDTAVLAARAALKSWAGMRAADRGRILNRFADLLEAHAEELITLESLDAGKPLAAVRRQDLPAVVDTVRYYAGWCDKIHGAVIPTRPDALTYTVREPVGVVAAIIPWNFPLMIGMWKIAPALACGCTLIVKPAEITPLTALRVAELALEAGVPPGVFNVVTGKGSVVGNALVAHPGIDKVTFTGSPGVGRGIMQGAASNFKRVTLELGGKSANVIFADADIDAATRAAASGIFFNSGQVCSAGSRILAQRKVYDEVVERLTTRARAIRVGDPASPDTTMGPVVSAAQMKTVLDYVEIGKREGASAVTGGARIGQRGFFVEPTVFANVEHEMRISQEEIFGPVASVIPFEDEAEAVRIANGTAFSLAAGVWSADIARVHKVAGELRAGTVWINTYGYTDVRLPWGGAGDSGLGREHGDAAIENFTEPKAIWLSLR

SEQ ID NO: 21215 - protein, 105 aa, Glycine max
  unsure (1)..(105): unsure at all Xaa locations
QAHQPKSLRYIGSMVADVHRTLLYGGLFLCPADQNXPNGKLPVLYEVFPMSFLMEQAGGQSFTGKERALDLVPTKLHQRSPIFPGSYDDVEEIKALYAAAEGEPQ

SEQ ID NO: 21216 - protein, 135 aa, Zea mays
  unsure (1)..(135): unsure at all Xaa locations
MAAGRELVVSFGEMLIDFVPTVAGVSLAEAPAFLKAPGGAPANVAIXAVSRLGGGAAFVGKLGDDEFGRMLAAILRDNGVDDGGXVVFDSGARTALAFVTLRADGEREFMFYRNPSADMLLTADELNVELIKRVS

SEQ ID NO: 21217 - protein, 390 aa, Schizosaccharomyces pombe
KNQTHIFREMSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGPPLFPGDSSVEQLVEIIRVLGTPPYHEISAMNPTYVNHSLPNVRPHTLESVMPHNCTKSAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 21218 - protein, 352 aa, Xylella fastidiosa 9a5c
MNVMGFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSTFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYMGPLSMPVNAGGVVRGRRAISGSFIGGVPETQQMLDFCGQHGIVSDVEIIPIQKINEAYERMLKSDVKYRFVIDMTSLTSSGA

SEQ ID NO: 21219 - protein, 273 aa, Lycopersicon esculentum
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 21220 - protein, 497 aa, Oceanobacillus iheyensis HTE831
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 21221 - protein, 183 aa, Escherichia coli O157:H7 EDL933
MTATAQQLEYLKNSIKSIQDYPKPGILFRDVTSLLEDPKAYALSIDLLVERYKNAGINKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 21222 - protein, 289 aa, Streptococcus suis
MKGIILAGGSGTRLYPLTRAASKQLMPIYDKPMIYYPLSTLMLAGIKDILIISTPQDLPRFKDMLGDGSELGISLSYAEQPSPDGLAQAFIIGEEFIGDDNVALILGDNIYHGNGLTKMLQRAASKEKGATVFGYQVKDPERFGVVEFDADMNAISIEEKPEEPKSNFAVTGLYFYDNDVVEIAKNIKPSPRGELEITDVNKAYLERGDLSVELMGRGFAWLDTGTHEGLLEAAQYIETVQRLQNVQVANLEEIAYRMGYITKEQVYKLAQPLKKNEYGQYLLRLIGEA

SEQ ID NO: 21223 - protein, 455 aa, Nostoc punctiforme
MAIATINPATGETLKTFEALNDTEILAKLDLANQAFEKYRQTDFSERSQWLQKAADILEQDKAEFAKLMTLEMGKPFKAAIAEVEKCAVVCRYYAEHAPSFLADVSVKTDASQSFVRYQPMGAILAVMPWNFPFWQVFRFAAPALMAGNVGLLKHASNVPQCALAIEDIIRRAGFPEGAFQTLLIGAAKVADLMADDRVKAATLTGSEPAGISLAVAAGKQIKKTVLELGGSDPFIVLESADLETAVVTATTARMLNNGQSCIAAKRFIVAEAIADKFEKLLLEKFEALKVGDPMQSDTDLGPLATPGILQDLDQQVQAATKIGGKVLTGGHPLSDRPGNFYPPTIIIDIPPDTPIAKEEFFGPVALLFRVPDIDAAIKLANDSPFGLGASAWTKNDQECDRLIEEIEAGAVFINSMVKSDPRLPFGGTKRSGYGRELSIQGIHEFVNVKTVWVK

SEQ ID NO: 21224 - protein, 353 aa, Escherichia coli
MLYTSQTTPEKDQKMSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 21225 - protein, 310 aa, Staphylococcus arlettae
GFGRIGRLAFRRIQNVDGIDVVAVNDLTDDEMLAHLLKYDTMQGRFTGEVEVENDGFRVNGQEVKSFSEPDPNKLPWGDLDIDVVLERTGLFADKDKASAHIDAGAKKVLISAPASGDLKTIVFNTNHNELDGSETVVSGASCTTNSLAPVAKVLNDDFGLVEGLMTTIHAYTGDQSTQDAPHRKGDKRRARAAAENIIPNSTGAAKAIGLVIPEIDGKLDGGAQRVPVATGSLTELTVVLDKEVTVEDVNSAMKNASNESFGYTEDEIVSSDVIGMTYGSLFDATQTRVMTVGNQQMVKVAAWYDNEMS

SEQ ID NO: 21226 - protein, 230 aa, Dechloromonas sp. RCB
MNTNFEIANQGSSGLALQQNRVLRNTYMLLGLSMVPTVIGALVGIQMGFSFLAGSPLMSFLLFMGIAMGFMWGIEKNKDSGLGVALLLGFTFFMGLMLSRILQVALGFSNGGSMIAMAAGGTGAVFFTMSTVAAVSKRDFTGMGKFLFVGMIVILLAAVANIFFQIPALSLTIAVAVVGIFSAYILYDISRIVQGGETNYVSATLAVYLDVYNVFVSLLQLIMAFTGERD

SEQ ID NO: 21227 - protein, 517 aa, Dechloromonas sp. RCB
MLPGPAGVYRPMRILRLLKIASVASRFGLDEMVLEHEPSGRLVRIANALQFWRDLSTPRAVRLRLALESLGPIFVKFGQVLSTRRDLMPPDIADELARLQDRVPPFDSALALAEIEKAYGRPASEVFAEFDATPIASASIAQVHFAKLREEDGGHEVAVKILRPNMLSVIEHDLALMDNLAMLLEKLWSDGKRLKPREVVAEFAKYLRDELDLMREAANASQLRRNFTDSQLLIVPEVHWDFCTSTVMVMERMKGTPISQIDKLRADGIDLSKLSAAGVEIFFTQVFRDGFFHADMHPGNIFVAPDGRYIALDFGIVGTLTDSDKNYLAQNFLAFFRRDYKRVAEAHIESGWAPKDTRVDEFEAAIRAVCEPIFDRPLKDISFGKILLRLFQTSRRFNVEIQPQLVMLQKTLLNIEGLGRQLDPELDLWKTAKPFLERWMSEQIGWRGLIKTFKQEAPYLARTIPQLPRLVHQALSNPTKADLQPQLAQLIAAQHQQNRWLAIIALLLALLVGALFA

SEQ ID NO: 21228 - protein, 492 aa, Rhodobacter sphaeroides
MLDSVTDLRSLLKDPSLLETRAFVAGEWVDADDGATFEVTNPARGDVICTVPDLGRAETARAIAAAEEAMKEWAARTGKERAQVMRKWFDLMMANQDDLGAILTAEMGKPLAEAKGEIAYGASFIEWFGEEAKRIYGETIPGHMRDKRITVLKQPIGVVGSITPWNFPNAMITRKCGPALAAGCGFVARPAAETPLSALALAVLGERAGLPKGILSVITSSRSSDIGKEMCENPIVRKLTFTGSTEVGRILLRQAADQVMKCSMELGGNAPFIVFDDADLDAAVQGAMASKFRNNGQTCVCANRIYVQSGVYDAFAEKLAAAVKKLKVGDGLVEGTEAGPLINEKAVAKVEEHIRDVLDGGGQVLTGGKRHALGGTFFEPTVVTGVKQEMKVSTEETFGPLAPLFRFETEDEAVGYANDTIFGLASYFYARDVGRITRVQEALEYGIVGVNTGIISTEVAPFGGVKQSGLGREGSRHGIEDYLEMKYICLSI

SEQ ID NO: 21229 - protein, 491 aa, Fusobacterium nucleatum subsp. nucleatum ATCC 25586
MENILKKSYKMFINGEWIDSSNGVMVKSYAPYNNELLSEFPDASESDIDFAIKSAKEAFKTWRKTTVKERARILNKIADIIDENKDLLATVETMDNGKPIRETKLVDIPLAATHFRYFAGCILADEGQATVLDEKFLSLILREPIGVVGQIIPWNFPFLMAAWKLAPALAAGDTVVLKPSSTTTLSLLVLMELIQDVIPKGVVNLVTGKGSTAGEFLKNHPDLDKLAFTGSTAVGRDIALAAAEKLIPATLELGGKSANIILDDADIEKALEGAQLGILFNQGQVCCAGSRIFVQEGIYDEFISKLVKKFENIKIGNPLDPTTIMGSQIDARQVKTILDYVEIAKQEGGVILTGGVKYTENGCDKGNFVRPTLITNVNNGCRVSQEEIFGPVAVVIKFKTDDEVIAQANDSEYGLGGAVFTKNINRALKLAREIQTGRVWINTYNQIPEHAPFGGYKKSGIGRETHKVILEHYTQMKNILIDLEEGTSGLY

SEQ ID NO: 21230 - protein, 473 aa, Schizosaccharomyces pombe
MSSSPTESEILPKESHNSIDEQSQQPANTDTLVKDNSFNEQDDQEVDNDYKSNDEPVQSQDPISPNMASNESGNSENTSNYGSSRDENVYQKTTLWMGELEPWVTEAFIQQVWNTLGKAVKVKLIRNRYTGMNAGYCFVEFASPHEASSAMSMNNKPIPGTNHLFKLNWASGGGLREKSISKASEYSIFVGDLSPNVNEFDVYSLFASRYNSCKSAKIMTDPQTNVSRGYGFVRFTDENDQKSALAEMQGQICGDRPIRVGLATPKSKAHVFSPVNVVPVSMPPVGFYSAAQPVPQFADTANSTVFVGGLSKFVSEEELKYLFQNFGEIVYVKIPPGKGCGFVQFVNRQSAEIAINQLQGYPLGNSRIRLSWGRNQNPIAAPALNYQSQVSQTTIPATSLFPAMSLPPQAQFSPYPAVAPSPLALQTRGAPIGMEISIGSPALVPDQMHIPENGNSDTMPVPNTQGKHLSAEE

SEQ ID NO: 21231 - protein, 78 aa, Oryza sativa (japonica cultivar-group)
MLETEDIGVFLLQDLHQQRGRLIHAHDILHNVDDNIGKSRRIIGAMVRRMDRNKWIIGFIIALLVLAILVILYFKFVH

SEQ ID NO: 21232 - protein, 288 aa, Streptococcus pneumoniae R6
MSRQTPSLSFEVFPPTPAVGNDNIISALQDMQELAPHFISVTASNNKFNIKETTVRLADFIQNDLAIPTIAHLPAIYLTKDKVAETIADLDKVGVQKILALRGDIIPDVEPQKDFRYATDLIELIKERAPHFDIIGACYPEGHPDSPNQISDIQNLKKKVDAGCSSLVTQLFFDNERFYDFQDKCILAGIDVPIHAGIMPILNRNQALRLLKTCENIHLPRKFKAILDKYEHDPESLRAAGLAYAVDQIVDLVTQDIAGVHLYTMNNADTAKYIHQATHALFNHQSLG

SEQ ID NO: 21233 - protein, 478 aa, Phyllophora truncata
VKNERYEAGVIPYAKMGYWDPDYVVKETDVLALFRVTPQPGVDPVEASAAVAGESSTATWTVVWTDLLTACDLYRAKAYKVDAVPNTSDQYFAYISYDIDLFEEGSIANLTASIIGNVFGFKALKALRLEDMRLPVAYLKTFQGPATGIIVERERMDKFGRPFLGATVKPKLGLSGKNYGRVVYEGLKGGLDFLKDDENINSQPFMRWKERYLYSMEGVNRAIAASGEIKGHYLNVTAATMEDMYERAEFAKQLGSIIIMVDLVIGYTAIQSMAIWARKNDMILHLHRAGNSTYSRQKIHGMNFRVICKWMRMAGVDHIHAGTVVGKLEGDPLMIRGFYNTLLLPYLEINLPQGIFFEQDWASLRKVTPVASGGIHCGQMHQLLDYLGNDVVLQFGGGTIGHPDGIQAGAIANRVALETMVVARNEGRDYVAEGPEILQNAAKTCGPLQTALDLWKDITFNYTSTDTADFVETPTANV

SEQ ID NO: 21234 - protein, 149 aa, Glycine max
  unsure (1)..(149): unsure at all Xaa locations
MDHQADTNRTDLMTITRFVLNEQSKYPESRGDFTILLSHIVLGCKFVCSAVNKAGLAKLIGLAGETNVQGEEQKKLDVLSNEVFVKALISSGRTCLLVSEEVEEAIFVPSSHRGKYIVVFDPLDGSSNIDXRVSIGTIFGIYMVKNEAE

SEQ ID NO: 21235 - protein, 362 aa, Corynebacterium glutamicum ATCC 13032
MTLTDNSKNVDAVILVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 21236 - protein, 244 aa, Oryza sativa (japonica cultivar-group); identical to SEQ ID NO: 3786

SEQ ID NO: 21237 - protein, 437 aa, Pneumocystis carinii
MFMTGQCSKKESKYEPLVMSTRIGRRYNRNKGPDASYKFPMVYPTTRCRLKLLKMERIKDYLLLEQEFVSNQELLKLDSEKRDQKGEEEDDDKLQSLIGSPMGVGTLEEMIDDDHAIVSSATGPEYYVSIMSFVNKDLLEPGCSVLLHHKAVSIVGVLSDDIDPMVSVMKLDKAPTESYADIGGLESQIQEIKETVELPLTHPELYEEIGIRPPKGVILYGEPGTGKTLLAKAVANQTSATFLRIVGSELIQKYLGDGPKFVRELFQTAQDNSPSIVFIDEIDAIGTKRYDSTSSGEREIQRTMLELLNQLDGFDDRGDVKVIMATNRINDLDPALIRPGRMDRKILFETPDQNTKRKIFQIHTSKMNLGDDVLIEEFITAKDEMSGADVKVIAICTEAGLLALRERRMRVVADDFRKAKEHVLKTKQKNIQGELYI

SEQ ID NO: 21238 - protein, 536 aa, Nicotiana tabacum
MAKDLQVLNALDVAKTQLYHFTAIVIAGMGFFTDAYDLFCISLVTKLLGRIYYHRDGALKPGSLPPNVSAAVNGVAFCGTLAGQLFFGWLGDKMGRKKVYGMTLMMMVICSIASGLSFGHTPKGVMTTLCFFRFWLGFGIGGDYPLSATIMSEYANKKTRGAFIAAVFAMQGFGILAGGMVAIIVSAAFKGAFPAPTYHADALASTVSQADFVWRIILMFGAIPAAMTYYWRMKMPETARYTALVAKNLKQAANDMSKVLQVEIEEEQEKVENVSQNTGNEFGLFSKEFLRRHGLHLLGTASTWFLLDIAFYSQNLFQKDIFSAIGWIPPAETMNALEEVYRIARAQTLIALCSTVPGYWFTVFFIDRIGRFAIQLMGFFFMTVFMFALAIPYHHWTLKDNRIGFVIMYSLTFFFANFGPNATTFVVPAEIFPARLRSTCHGISAAAGKAGAMIGAFGFLYAAQPTDPKKVDAGYPAGIGVRNSLIVLGCVNFLGMVFTFLVPESKGKSLEEMSRENEGEEESGTEMKNSGRTVPV

SEQ ID NO: 21239 - protein, 194 aa, Cytophaga hutchinsonii
MKKKIWISVVVLFILALIIKPVMTAAQQKKEFKYHNNLLKTITLTSTDFIADGKIPVECTGDGEELSPALQWTNIPKGTKSFVLLMTDYDAPAPFFKISTVDHWVIYNIPAEHTALSKGLTSGQLQESNISSGQNFKKGIEYKGPKPPLGVHNYYFRVYALSVSALNLKNPTKQEVMNAMKGKVLAYGELIGKY

SEQ ID NO: 21240 - protein, 488 aa, Myriotrichia clavaeformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEEMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 21241 - protein, 475 aa, Streptococcus mutans
MTKQYKNYVNGEWKLSENEIKIYEPASGAELGSVPAMSTEEVDYVYASAKKAQPAWRALSYIERAAYLHKVADILMRDKEKIGAILSKEVAKGYKSAVSEVVRTAEIINYAAEEGLRMEGEVLEGGSFEAASKKKIAVVRREPVGLVLAISPFNYPVNLAGSKIAPALIAGNVIAFKPPTQGSISGLLLAEAFAEAGLPAGVFNTITGRGSEIGDYIVEHQAVNFINFTGSTGIGERIGKMAGMRPIMLELGGKDSAIVLEDADLELTAKNIIAGAFGYSGQRSTAVKRVLVMESVADELVEKIREKVLALTIGNPEDDADITPLIDTKSADYVEGLINDANDKGATALTEIKREGNLICPILFDKVTTDMRLAWEEPFGPVLPIIRVTSVEEAIEISNKSEYGLQASIFTNDFPRAFGIAEQLEVGTVHINNKTQRGTDNFPFLGAKKSGAGIQGVKYSIEAMTTVKSVVFDIK

SEQ ID NO: 21242 - protein, 487 aa, Halobacterium sp. NRC-1
MSSSQTRSPDAELGLLDATMIGMGAMIGAGIFVLTGLAAEIAGPAAILVFALNGVVTAFTGLSYAELAASIPKSGGGYAFVREIFGDFSSFIMGWMLWFAYMIAGALYALGFAPNFLELLHVYGLVAPPDQVGAIAVPLLDASVPAAFVLAFIAVLGLVALNAVSTAASGSAETIFTIIKVSILVVFVAFGATSPLFSGAEFQPLFGVGGGPAAILPAMGLTFIAFEGYDLITTVTEEVKNPRENIPKAIFVSLIATVIVYLAVVTVAVGTLGADGLAAAGEAGIAEAATSFMPTGLPIIQNGGALIVFGAVFSTLTALNAVVIASSRVAFSMGREGQLLPSFGQIHHRYGTPFVAIIASAVVMLASVALPTQSAGNMSSLFFLLSFIIVNVAVIRLRRERPDMNRPYEMPFYPAPPLIGIALNLVLSVVLVDYLVRTDPLALALSAAWIVLGTAAYYAHASRQSAAGDDEDTTTISADAEHTPHDH

SEQ ID NO: 21243 - protein, 876 aa, Saccharomycopsis fibuligera
MLMIVQLLVFALGLAVAVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 21244 - protein, 190 aa, Thermococcus kodakaraensis
MVDMSNVKLRIENIVASVDLFTDLNLEKVIEICPSSKYNPEEFPGIICRFDDPKVALLIFSSGKLVVTGAKSVDDIKRAVYKLIEMLKKIGAKFTREPQIDIQNMVFSGDIGMEFNLDAVALILPNCEYEPEQFPGVIYRVKEPRAVILLFSSGKIVCSGAKSEQDAWEAVKKLLRELEKYGLIEEEEEW

SEQ ID NO: 21245 - protein, 404 aa, Enterococcus faecium
MNTLPINTGDTAFMILCTAMVCLMTPGLAFFYGGLARKNNILTIMSQSFLSVGITTIMWVFGGFGLAFGRDIGGVIGNPADFFLMRHVTSFPNMFHGATIPFLMFFLYQLMFIVITVPLMTGAFAGRLNLKGYIILVIFWNLLIYFPVCHWIWGGGFLDQMGFRDFAGGAVIHTTAGFGSLACILTLGQRKIPLGERSQHSSLMAAAIGTGLLWFGWFGFNSGGALRADEQAVNAFGSTFIALAFAMITWLIIAKVKGNGFDFVDVLTGSVAGLAAITPCAGYVEAKSAMLIGIIAGIVCHAAVDFRKKKQWDDALDVWGVHGMGGFTGTILIGIFASNSHLLTNPSSWYFLGIQVIGVIITAVYAYVLTTVILKSAMHFTTITTTKEEQEEGLDFFFFGNKLN

SEQ ID NO: 21246 - protein, 561 aa, ASPERGILLUS NIDULANS FGSC A4
MSSVVESPPKTGFSLVLQNPYLCGVASFSTLGGLLFGYDQGVISGVITMESFGARFPHIFTDSGFKGWFVSTLLLAAWFGSLINGPIADRLGRKMSINLAVVIFIVGSAIQCAAVNVGMLFAGRAVAGLAVGMLTMVVPLYISEVSIPEIRGGLVVVQQLSVTIGILVSYWIDYGSNYIGGARCAPNVPYAGSSFDPYTDVPAGGCTGQSEASWRLPLAVQIAPAIILGAGMLFFPDSPRWLLMKERDDEALSALSRLRRQARDAPVLRNEYLEIRASIMLENSFARENFPNLSGIRLHAAQYLSFLTTWARFRRLAIGCCVMFFQQFMGCNAIIYYAPTIFSQLGLDGNTSSLLATGVYGIVNCLSTLPALFFIDKVGRRVLLMAGATGTCISLVIVGAIVGAYGASLVDHKAAGWAGIAFIYIYDVNFSYSFAPIGWVLPSEIFNLSIRSKAISITTSATWMCNFIIGLVTPDMLDSISWGTYIFFAAFCLLALAFTFFFIPETRGKTLEDMDLIFGDTAAHEEKTRIKRIEAELHGTGLDEDEAQKPMKQHAEVVDAV

SEQ ID NO: 21247 - protein, 427 aa, Zea mays
  unsure (1)..(427): unsure at all Xaa locations
RCRCCAQQERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKMVSLELGGKSPLIIFDDADVDMAVNLSRLAVFFNKGEVCVAGSRVYVQEGIYDEFVKKAVEAARSWKVGDPERIIXSVGRXVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 21248 - protein, 263 aa, Glycine max; identical to SEQ ID NO: 13293

SEQ ID NO: 21249 - protein, 172 aa, Xanthomonas campestris pv. campestris str. ATCC 33913
MPSNLEFIPLHLCVLTVSDSRTLADDRSGDYLVDALTHEGHVLHARALCPDDRYRMRAIVSAWIADAQVDGILVTGGTGFTGRDSTPEAITPLLDKLMPGFGEMFRAISVAEIGTSSLQSRAFAGLANHSFVFCLPGSTSACRTAWEKIVRAQLDARTKPCNLATLRPRLSE

SEQ ID NO: 21250 - protein, 470 aa, Escherichia coli
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRSTGIADTVLFGPEPEFFLFDDIRFGSSISGSHVAIDDIEGAWNSSTQYEGGNKGHRPAVKGGYFPVPPVDSAQDIRSEMCLVMEQMGLVVEAHHHEVATAGQNEVATRFNIMTKKADEIQIYKYVVHNVVRNRFGKTATFMPKPMFGDNGSGMHCHMSLSKNGVNLFAGDKYAGLSEQALYYIGGVIKQPKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEAKEIPQVAGSLEEALNELDLDREFLKAGGVFTDEAIDAYIALRREEDDRVRMTPHPVEFELYYSV

SEQ ID NO: 21251 - protein, 518 aa, Oryza sativa (japonica cultivar-group)
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 21252 - protein, 190 aa, Mitthyridium sp. Wall 3715
GGAKKVVISAPSKDAPMFVIGVNEDKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSRSSIFDAKAGIALS

SEQ ID NO: 21253 - protein, 209 aa, Lactobacillus plantarum WCFS1
MTENKHRRPVVIGVTGGSGSGKTTVSNAIYNQLSGQSLLILQQDSYYNDQSEMTMAERHAVNYDHPLAFDTDLMIKQIKQLLAYQPIEKPVYDYEQYTRSDKTIHQEPRDVIIVEGVLILDDQRLRDLMDIKVFVDTDDDIRIIRRIQRDIKERGRTLDSVIGQYLATVKPMYHQFVEPTKRYADLIVPEGGENEVAIDLLTTKVRSIL

SEQ ID NO: 21254 - protein, 339 aa, Filobasidiella neoformans
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGSAKKVVISAPSADAPMFVCGVNLDAYKPEYQIVSNASCTTNCLTPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 21255 - protein, 831 aa, Aquifex aeolicus VF5
MKGVILAGGFGTRIQPLTNSIPKPMLPVANRPIMEHVVHRLKEAGIEEIVVLLYYQAEVIKNYFKDGSDFGVKITYVQPEADYGTAGAVKQAQNYLNETFIIVSGDVITDFNLSELIAFHKSKSSKFTLALYSVENPLQFGVVITNKEGKVLKFLEKPGWGEVFSDTVNTGIYVVEPEILNYIPEDKPFDFAMDLFPKLMKSGIDLWALKMRGYWRDIGNIDSYRDVHKDIFAGLVKIRIPGRIITTKEARIYVEEGTEIPENVSLKGTVILGKNVKVGEGSELKNCVIGNNTVIGRNVKLFDSVLWWNVSIDEESEIRNGVICNDVKIGKRVKAKEGVVIAEDCEVEDEVLFLKDVVVWPEKVIEKGSVVTKNIVCESKWEKGIFKGNKVIGRINVELTPDNATKLGMALGSVLPPKSTVILARDYHRASRTIKRSFLGGILSTGINVIDLHLSPLPVMRFTLTEDKKAVCGVYFSISQEFPGSVEICVFDENGLPIDTNFQKKIERVFFREAYRFETFTDLGLIKEKPYFSENYVTKLLSSIDGDSIKLSSNKVVYDALHSPISPFISEVLGKLEIENVILNALYDERKLSRISTYASSSEGNVSKVLKALSYDVGFVMEPSATKLKLVDDRGRTISGDRLLLVVLMLLDKSAEKQLRVYLPVWAPEVLDAILNNVIVERGKFTNLRKSFIEDFYMLADTDGSFTFTEFSYSPDALYASLKIMEMLTKLKVKVSEIYDSLPEYYFLHEVVSCSSEKKGTVLRKISEMAEGKEASFIEGVKIYEDYGNWVLVLPDSYKDLIHVYVQSTERERAEELIKNYMEIVRGICKK

SEQ ID NO: 21256 - protein, 155 aa, Lycopersicon peruvianum
MDLRLLGIDNTPLFHTLHHMMEAAGEDSVNAPSKIYVRDAKAMAATPADVKEYPNSYVFVVDMPGLKSGDIKVQVEEDNVLLISGERKREEEKEGAKFIRMERRVGKFMRKFSLPENANTDAISAVCQDGVLTVTVQKLPPPEPKKPKTIEVKVA

SEQ ID NO: 21257 - protein, 170 aa, Zea mays; identical to SEQ ID NO: 3644

SEQ ID NO: 21258 - protein, 510 aa, Triticum aestivum; identical to SEQ ID NO: 6950

SEQ ID NO: 21259 - protein, 390 aa, Oryza sativa (japonica cultivar-group); identical to SEQ ID NO: 11559

SEQ ID NO: 21260 - protein, 358 aa, Triticum aestivum
MGCSFSGLNALYDTVGGGGGDIWVNDYRFRVLRRLGDAGPAGSSVFLVKEVVAAAAVSDGTAGAGPGAAGLAKKKGVDPSHISADGTYALKKVLIQSDQHLELVRQEIRVSSQFSHPNLLPLLENAIIAVKGVQDGSQNHEAYLLFPVHLDGTLQDVTKSMQEKKEYLSTITILQIFRQLCAGLKHMHSFEPPYAHNGVKPDNVLITQRKEQPHLAILMDFESARPARRAIRSQAEALQLQEWASEHCSAHFRAPELWECPPHADIDERTDVWSLGCTLYAMMYGKSPFDYELDESAGESLVTVIKSAQVKWPTETGSSYPDTLRQFVTWMLQPHPAVRPNIDDIIIHVDKLIAKHSI

SEQ ID NO: 21261 - protein, 412 aa, Glycine max
MKMKLLLMLLLVFLLLHQPIWAADPPAFSPGEEQHHMNKKVVIAIVVATTALAALIFTFLCFWIYHHTKYPTKSKSKNVQSPDAEKGITLAPFLNKFSSIKIVGMNGSVPIIDYKQIEKTTNNFQESNILGEGGFGRVYRARLDHNLDVAVKKLHCETQHAEREFENEVNMLSKIQHPNIISLLGCSMDGYTRFVVYELMHNGSLEAQLHGPSHGSALTWHMRMKIALDTARGLEYLHEHCHPAVIHRDMKSSNILLDANFNAKLSDFGLALTDGSQSKKNIKLSGTLGYVAPEYLLDGKLSDKSDVYAFGVVLLELLLGRKPVEKLVPAQCQSIVTWAMPQLTDRSKLPNIVDPVIKNTMDPKHLYQVAAVAVLCVQPEPSYRPLITDVLHSLIPLVPIELGGTLRVSQVK

SEQ ID NO: 21262 - protein, 99 aa, Oryza sativa
  unsure (1)..(99): unsure at all Xaa locations
RVRGRVGGRVGGRVGRTLLYGGVFLYPADKKSPNGKLRVLYEVFPMSFLMEQAGGQSFTGKERALGLVPTKXFTERSPIFLGSFEDVEEIKGLYAAQAK

SEQ ID NO: 21263 - protein, 357 aa, Solanum tuberosum
MALQIAKRLLRCRADSVASSVRFFDRTFTSESNSNLIRATLFPGDGIGPEIAESVRQIFKVAEVPIEWEEHYVGTEVDPRTNSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEIKYEEVVIDNCMMMLVKNPALFDVLVMPNLYGDIISDLCAGLIGGLGLTPSCNIGEGGIALAEAVHGSAPDIAGKNLANPTALLLSSVSMLRHLELHDKADRIQDAILKTIAGGKVPNWRPWRHCYNN

SEQ ID NO: 21264 - protein, 142 aa, Thermotoga maritima
MLLGRREDIFRPFRELQREIDRLFDDFFRTEVRPAPDMDVFETDDEVVIEVEIPGIDRKDVQITVEENILKISGEKKLEREQKGKNYYYVERSAGKFERAIRLPDYVDVEKIKAEYKNGVLTIRVPKKEERKKKVIEVEVQE

SEQ ID NO: 21265 - protein, 118 aa, Glycine max
VTAAFAFSGTELVGLAAAETKNPLKSLPGAVRQVFWRITLFYVLGLLFVGLLIDSTDPRLLGSGALIDVTASPFVLVGEYAGLKGFDSFMNVVILVSVVSIGVSGVYGGSRTLTALAE

SEQ ID NO: 21266 - protein, 137 aa, Pectobacterium carotovorum subsp. carotovorum
GIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQAAG

SEQ ID NO: 21267 - protein, 364 aa, Triticum aestivum
MDYTNAIHIIPDAAGPESWANSAAPPGGDSGIWATEDDYSQWNGDQGLSGGGYGGDRNSSQPHSRAGSEQPPPGKKPRGSGPSGGGDAGSTSKSRAIGKMFFKTKLCCKFRAGTCPYVTNCNFAHGMEELRKPPPNWQEIVAAHEEATEQREEHQIPIMTSSNVVPGDSVSGRAYKGRHCKKFYTEEGCPYGDACTFLHDEQSKARESVAISLSPSVGGGSYNSAAAAAASPNGPTILKPSNWKTRICNKWEMTGYCPFGSKCHFAHGAAELHKYGGGLVDIDGRDIASTPDSKQAAASSKLPVETAAASTAVPPHADVYHLGSQSQRSALASQRSGQLQRPIQKWKGPDKISRIYGDWIDETD

SEQ ID NO: 21268 - protein, 151 aa, Oryza sativa
MPLYSVLPLTSFIFPFFFFFTLSRRRRQPARAGTAQPRRGGGGGTGNVVEAVGHVRSVMGEIHALRNMDDDEVFAYAKRIAAPYNLVMQTKQLGRLPVVQFAAGGVATPADAALMMQLGCDGVFVASGIFKSGDPARRARAIVQSVTHCRD

SEQ ID NO: 21269 - protein, 502 aa, Lotus japonicus
MAALPECSAANLAQLIGPNATDAAAVAGFICDQFTAVGQRFSDTAFAVDSTYLLFSAYLVFSMQLGFAMLCAGSVRAKNTMNIMLTNVLDAAAGGLFYYLFGFAFAFGAPSNGFIGRHFFGLKDVPTVAFDYSYFLYQWAFAIAAAGITSGSIAERTQFVAYLIYSSFLTGFVYPVVSHWFWSGDGWASATNTGNLLFGTGVIDFAGSGVVHMVGGVAGLWGALIEGPRIGRFDHAGRAVSLRGHSASLVVLGTFMLWFGWYGFNPGSFTKILSAYDSGNYYGQWSAIGRTAVTTTLAGCTAALTTLFGKRIISGHWNVTDVCNGLLGGFAAITAGCSVVEPWAAIVCGFVAAVVLIACNMLAEKVRYDDPLEAAQLHGGCGAWGIIFTALFAKEEYVNQVYPGKPGRPYGLFMGGGGKLLGAHVIQILVIIGWVSATMGPLFFILNKMKLLRISTEDELAGMDLTRHGGFAYAYEDDESHKPGIQLRKIEPNSSSTPSAES

SEQ ID NO: 21270 - protein, 429 aa, Oryza sativa (japonica cultivar-group)
MATGKSGGSSAEDLGHHAGYYRLPNTHDARLFYFFFESRGSKGEDDPVVIWLTGGPGCSSELALFYENGPFHIADNMSLVWNDFGWDQESNLIYVDQPTGTGFSYSSNPRDTRHDEAGVSNDLYAFLQAFFTEHPNFAKNDFYITGESYAGHYIPAFASRVYKGNKNSEGIHINLKGFAIGNGLTDPAIQYKAYTDYSLDMGLITKSQFNRINKIVPTCELAIKLCGTSGTISCLGAYVVCNLIFSSIETIIGKKNYYDIRKPCVGSLCYDLSNMEKFLQLKSVRESLGVGDIQFVSCSPTVYQAMLLDWMRNLEVGIPELLENDIKVLIYAGEYDLICNWLGNSRWVNSMEWSGKEAFVSSSEEPFTVDGKEAGILKSYGPLSFLKVHDAGHMVPMDQPKVALEMLMRWTSGNLSNASSSFQRLDFTM

SEQ ID NO: 21271 - protein, 362 aa, Saccharomyces cerevisiae
MRSLNTLLLSLFVAMSSGAPLLKIREEKNSSLPSIKIFGTGGTIASKGSTSATTAGYSVGLTVNDLIEAVPSLAEKANLDYLQVSNVGSNSLNYTHLIPLYHGISEALASDDYAGAVVTHGTDTMEETAFFLDLTINSEKPVCIAGAMRPATATSADGPMNLYQAVSIAASEKSLGRGTMITLNDRIASGFWTTKMNANSLDTFRADEQGYLGYFSNDDVEFYYPPVKPNGWQFFDISNLTDLSEIPEVIILYSYQGLNPELIVKAVKDLGAKGIVLAGSGAGSWTATGSIVNEQLYEEYGIPIVHSRRTADGTVPPDDAPEYAIGSGYLNPQKSRILLQLCLYSGYGMDQIRSVFSGVYGG

SEQ ID NO: 21272 - protein, 193 aa, Leucophanes albescens
GGAKKVVISAPSKDAPMFVMGVNEDKYTNEDIVSNASCTTNCLAPLAKVINDKFGILEGLMTTVHATTATQKTVDGPSNKDWRGGRSAASNIIPSATGAAKAVGKVLPELNGKLTGMAFRVPTTDVSVVDLTVRLEKPASYDAIKAALKEASQGKLKGILGYTEDEVVSSDFITDSRSSIVDAKAGIALSDTF

SEQ ID NO: 21273 - protein, 367 aa, Rosa hybrid cultivar
MERLNSFRHLNQKWSNGEHSNELLHAQAHIWNHIFSFINSMSLKSAIQLGIPDIINKHGYPMTLSELTSALPIHPTKSHSVYRLMRILVHSGFFAKKKLSKTDEEGYTLTDASQLLLKDHPLSLTPYLTAMLDPVLTNPWNYLSTWFQNDDPTPFDTAHGMTFWDYGNHQPSIAHLFNDAMASDARLVTSVIINDCKGVFEGLESLVDVGGGTGTLAKAIADAFPHIECTVLDLPHVVADLQGSKNLKYTGGDMFEAVPPADTVLLKWILHDWSDEECIKILERSRVAITGKEKKGKVIIIDMMMENQKGDEESIETQLFFDMLMMALVGGKERNEKEWAKLFTDAGFSDYKITPISGLRSLIEVYP

SEQ ID NO: 21274 - protein, 297 aa, Zea mays
PRVRRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAHHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 21275 - protein, 206 aa, Oryza sativa (indica cultivar-group)
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNSRSAARSAPPPPPPPAAAVAARRTPPERRTRRRPAPSCRRASSSSQPPAPTPTQQRQRRRRRRRRPPCGRPRPCGARAGSSSTTVKRRRSPRRRRRRQGN

SEQ ID NO: 21276 - protein, 368 aa, Methylobacillus flagellatus
MTRLYDFAPSNIRAIAPYQPGKPITELAREMGLKPGVIIKLASNENPLGVSPKAYAAMQDALEDIARYPDGNSFALRDCVCRKFKLQPDQLVFGNGSNDILELAARAFLTPGTEAVYAQHAFAVYALVTQATGASGISVPARDFGHDLDAMLAAITDKTRLFIANPNNPTGTLLSKPALRDFLAKVPRQVLVVLDEAYDEYLAAELKSEAFSWLAEFDNLLISRTLSKAYGLAGLRVGFGVTSPGVADLMNRVRQPFNVNSVAQAAAVAALEDDEFVERSYALNQAGMQQLTEGLARLGLSYIPSYGNFVSFHVAQAAEVYQQLLKRGVIVRPVAAYDMPDYLRVSIGLHAENARFLEVLEQILKTRT

SEQ ID NO: 21277 - protein, 397 aa, Methanosarcina mazei
MAINEADTVWVLLSSALVLLMVPALALFYGGLVQRKNVLSSMMHSFVAMGVLALEWIIIGYSLAFSEGNWFIGGLENVFLSGIDPYSVTGTIPTYAFVAFQGMFAIITPALISGAIVGRVKFKSYIAFILLWGLIVYAPVCHWVWGGGFLTGEALDFAGGTVVHITAGMSSLAILAYLGKRRGYGVDSLKPHNVTLTLLGAGLLWFGWFGFNAGSALAANEIAALAFMTTLVAPAAAGFVWMALEWAHLGRPTALGFATGILAGLVGITPAAGFVTPVAAIAIGAIASFICYQAVMFKNRLGYDDSLDAFGVHGVGGIVGAILTGVYASVGGEGLLLGNSAQLMIQLQGVVITIVYAMACTLLIGFVLHKTIGLKVSESEEIIGLDKTQHGEAAYNI

SEQ ID NO: 21278 - protein, 311 aa, Streptococcus pneumoniae TIGR4
MHEIYLAGGCFWGVEEYFSRVPGVTDAVSGYANGRGETTKYELINQTGHAETVHVTYDAKQISLKEILLHYFRIINPTSKNKQGNDVGTQYRTGVYYTDDKDLEVINQVFDEVAKKYDQPLAVEKENLKNFVVAEDYHQDYLKKNPNGYCHINVNQAAYPVIDASKYPKPSDEELKKTLSPEEYAVTQENQTERAFSNRYWDKFESGIYVDIATGEPLFSSKDKFESGCGWPSFTQPISPDVVTYKEDKSYNMTRMEVRSRVGDSHLGHVFTDGPQDKGGLRYCINSLSIRFIPKDQMEEKGYAYLLDYVD

SEQ ID NO: 21279 - protein, 378 aa, Oryza sativa
MARRSAPLLQRLLSPTPSPSPSPPHSLAAAAVSRRTVTYMPRPGDGAPRAVTLIPGDGIGPLVTGAVRQVMEAMHAPVYFESYEVRGDMPTVPPEVIDSIRRNKVCLKGGLATPVGGGVSSLNVQLRKELDLYASLVNCFNLPGLPTRHDNVDIVVIRENTEGEYSGLEHEVVPGVVESLKVITKFCSERIAKYAFEYAYLNNRKKVTAVHKANIMKLADGLFLESCREVATKYPGIQYNEIIVDNCCMQLVAKPEQFDVMVTPNLYGNLVANTAAGIAGGTGVMPGGNVGQDHAVFEQGASAGNVGNVKVVEQKKANPVALLLSSAMMLRHLQFPSFADRLETAVKRVIAEGKYRTKDLGGSSTTQEVTDAVIAHLD

SEQ ID NO: 21280 - protein, 373 aa, Zea mays
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECTQNLNVVCQYYPPCPEPHRTVGVKRHTDPGFFTILLQDGMGGLQVRLGDGQNGGCWVDIAPRPGALMVNIGDLLQLVTNDRFRSVEHRVPANKSSDTARVSVASFFNTDVRRSERLYGPIPDPSKPPLYRSVRARDFIAKFNTIGLDGRALDHFRL

SEQ ID NO: 21281 - protein, 336 aa, Xanthomonas axonopodis pv. citri str. 306
MSRPSLTRFLIEEQHAGRIDAELRQLITIVSRACKRISIAVSKGALGGVLGDAGTGNVQGEAQKKLDVLSNDILLEANAWGGHLAACASEEMDHSQPVPDQYPSGDFLLLFDPLDGSSNIDVNVSVGTIFSVLRAPKGTEKPGDEHFLQPGTQQVAAGYCIYGPSTMLVLTLGHGTHAFTLEREEGSFLLTQANMRVPEDTAEYAINMSNQRHWEPAMQAYVGDLLAGKDGARGKDFNMRWIASMVADVHRILTRGGIFIYPWDKKDPSKPGKLRLMYEANPMSMLVEQAGGAATTGRERILDIQPTQLHQRVPVFLGSKNEVAEATRYHLDADKA

SEQ ID NO: 21282 - protein, 659 aa, Gossypium hirsutum
MAAATSNSALPKLSTLTSSFKSSIPISKSSLPFSTTPQKPTPYRSFDVSCSLSHASSNPRNPAASVTQKTAPPHYFISRYADDEPRKGADILVEALEREGVKDVFAYPGGASMEIHQALTRSKIIRNVLPRHEQGGVFAAEGYARSSGISGVCIATSGPGRTNLVSGLADAMLDSIPLVAITGQVPRRMIGTDAFQETPIVEVTRSITKHNYLVLDVDDIPRIVSEAFFLASSGRPGPVLIDVPKDIQQQLAVPKWNHSLRLPGYLSRLPKAPAEAHLEQIVRLVSESKKPVLYVGGGCLNSSEELKRFVELTGIPVASTLMGLGAFPISDELSLQMLGMHGTVYANYAVDKSDLLLAFGVRFDDRVTGKLEAFASRAKIVHIDIDSAEIGKNKQPHMSVCSDVKLALQGINKILETTGAKLNLDYSEWRQELNEQKLKFPLSYKTFGEAIPPQYAIQVLDELTGGNAIISTGVGQHQMWAAQFYKYKKPRQWLTSGGLGAMGFGLPAAIGAAVANPEAVVVDIDGDGSFIMNVQELATIRVENLPVKILLLNNQHLGMVVQWEDRFYKANRAHTYLGDPSNESEIFPNMLKFAEACGIPAARVTKKEDLKAAIQKMLDTPGPYLLDVIVPHQEHVLPMIPSGGAFKDVITEGDGRTQY

SEQ ID NO: 21283 - protein, 182 aa, Triticum aestivum
MSDEAASPPGGGGGGGGGGSDDGGGGGGFGGVREQDRFLPIANISRIMKKAIPANGKIAKDAKETVQECVSEFISFITSEASDKCQREKRKTINGDDLLWAMATLGFEEYIEPLKVYLQKYRETEGDSKLAGKSGDVSVKKDALGPHGGASGTSAQGMGQQVAYNPGMVYMPPQSHNGDIST

SEQ ID NO: 21284 - protein, 247 aa, GIBBERELLA ZEAE PH-1
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLKPAFVDIINATKQ

SEQ ID NO: 21285 - protein, 373 aa, Mastocarpus papillatus
VETDDGKFRAMVPSGGSTGIHEAHEMRDGDENKFSGKGVLKAIKNVNNEIAVTVIGMDPTDQEGIDQALADLDGQPDKSRLGANAILGVSMAVTRAGAAKKGIPLYKHINNLAGNPTPILPVPSFNVLNGGSHAGNPLAMQEFMILPTGAESFKEAMQVGVEVYHKLKSVIKQKYGQSSTSVGDEGGFAPNIKDSEEALELIQTAVKEAGHSDIVQIGMDVAASEFYNKETKKYNLNFKNPAGSTNPAGMKSADELLRMYKLFAANYGVISIEDPFDQDDFTSFEKMTGELNELIQIVGDDLLVTNPERIERAIERNACNALLLKLNQIGTVTEAIEANNLARNAGFGVMVSHRSGETEDSFIAALCAGLGTG

SEQ ID NO: 21286 - protein, 428 aa, Neisseria meningitidis Z2491 [sequence omitted]

SEQ ID NO: 21287 - protein, 371 aa, Zea mays
MRRHMAPIKEQKHTTSAEQQVMLDAELQLWNHTFGYVKSMALKAALDLGIPEAIHQHGGTATLPQIVTRVKLHPSKKPCLRRLMRVLTLTGVFGAQEAHDDDGGCDDELVYTLTPASRLLVGSPGQNVGPFLTVMLGPIFVSSFLDLRGWFQHETPDPSPFKMTHGRDIWELAAHDAAFGRLFDAGMVADSSFIMDVVVRECGGVFEGISSLVDVAGGLGGATQTIAKAFPNLECSVLDLPNVVASAPADTAVKYVPGDMFESVPSADAVFLKWIMHDWGDADCVKILKNCKKAIPAQGGKVIILDIVVGAGSSCDRKNVETQCLFDLFIMFINGAERDERQWKKIIFEAGFTSYKIIPVLGIRSIIEVCL

SEQ ID NO: 21288 - protein, 336 aa, Streptococcus oralis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKAAAEKHLHAGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 21289 - protein, 147 aa, Clostridium perfringens str. 13
MKYTKKEKEELKKVLTEEEYYVTQENGTERPFTNEYWDFNGEGIYVDITTGEPLFTSKDKFHSSCGWPAFSKPIDRSIIKEKVDKSHGMIRTEVRSKLGDSHLGHVFCDGPEELGGLRYCINSASLKFIPKEELKEKGYEEYLELFK

SEQ ID NO: 21290 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENPCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 21291 - protein, 248 aa, Oryza sativa
KPSAQRINFSLQNKDGTVSTYECKRTSTWIEILNPCESFPNMVVDYPYPECTSSVLQALVLFKELCPGYRTEEIEKCVRNASMFIENTQGEDGSWLGTWGVCFTYGAFFSVKGLIAAGRTYENSSSIRKACDFIMSKQLNTGGWGESHVSNETKVYVNIKGDHAHAVNTAWAMLTLIYAGQMERDPAPLHCATKELITMQLETGEYPQHEHVGCFNCSLFFNYPNYRNLFPIWALGEYCNRLRSERRA

SEQ ID NO: 21292 - protein, 283 aa, Oryza sativa
  unsure (1)..(283): unsure at all Xaa locations
MASSDDGVVALYGGGKVSCKPPAATFSVKVGLAQMLRGGVIMDVVTPEQARLAEEAGACAVMALERVPADIRAQGGVARMSDPALIRDIKRAVTIPVMAKARIGHFVEAQILEAIGVDYVDESEALRRIREGAAMIRTKGEAGTGNVVEAVRHVRSVMGEIRALRNMDDDEVFSYAKRIAAPYDLVMQTKQLGRLPVVQFAAGGVATPADAALMMQLGCDGVFVGSGIFKSGDPARRARAIVQAVTHYSDPEILADVSAGLGDAMXGINLNDQNVERYAARSH

SEQ ID NO: 21293 - protein, 569 aa, Saccharomyces cerevisiae
MMTKAFFNKLPFEVFRRYVRTGKSIPQRSPRTRKSLLVGGTIASAVVLYNFNDTFHDSVKHTALTTKRIAVVTQATTRCFYHYKRALNKSYENKKEREVALNKCHKMCALITLHALRSNGGIYIKLGQHIGAMTYLLPKEWTDTMIPLQDHCPESTYEEIDELFKEDLGTSIEDMFLEFNKTPIGVASLAQVHVAKLKNSDGKGSSVAVKCQHPSLKEFIPLDVMLTRTVFELLDVFFPDYPLTWLGDELQSSIYVELNFTKEAENAEKTRHYFSKFKKQTALKIPKVIESHKRILIMEYVGGKRLDDLEYIDSHGISRSEVSSCLSHIFNNMIFTPNVGIHCDPHGGNLAIRSVKPAKDNGYHNFEIVLFDHGLYRYPSTRTRRLYAKFWLSLLFDKDQTKMKKYAKGFANITDEQFPLLAAAITGRSIDAALNYDISTSRTQEEMDVMANGILEGTLLSDLMSILSRIPRVVLLILKTNDLTRHLDECLQNPLGPERTFLIMTQYCAKTVYDEKVERINSEYARWSIKWMWENLTNWIVYERRINQLYFYDFVLWWKKFIPKTWLSS

SEQ ID NO: 21294 - protein, 737 aa, ASPERGILLUS NIDULANS FGSC A4
MRSLIRSGALNAFLAASLATGQVLTWDEAYTKATSDLSLLSQEEKVGIVTGVTWQGGPCVGNTYEPTSIPYPSLCLQDGPLSVRFANPVTVFPAGINAGATWDRELIRARGVAMGAESRGLGVHVQLGPVAGALGKIPSAGRNWEGFSNDPYLAGIAMAEAIQGMQSSGVQACAKHYLLNEQEYNRDTISSNADDRTIHELYLWPFYDAVKANVASVMCSYNKINGTWACEHDALLNGLLKGELGFKGHVLSDWNAQHSTVQSANTGLDMTMPGSDFSTPPGSIYWGDNLAAAIADGSVPQERLDDMVTRILAAWYLVGQDQGHPPVAFSSWDGGAASVNVTTPEHGELARTIARDSIVLLKNTNGSLPLAKPASLAVIGSDAIVNPDGANACADRGCNKGTLAQGWGSGTAEFPYLVAPLDAIEEKLAGAGTAIITSTTDDATSGAEAAAAAETAIVFITSDSGEGYITVEGHEGDRNNLDPWHNGNLLVQAVARTNTPTIVVLHSVGPVTLETILAEPNVVAVVWAGLPGQESGHALTDVLFGDYAPSGKLPFTIGKSEEDYGADWTTSQVDDFAEGLFIDYRHFDQYGIEPRYEFGFGLSYTSFNYSTLSTSISTTPGPTTGETIVGGPSDLFAPIGTVSAYVANTGHVAGAEVVQLYIGYPDSAPSIPPKQLRGFDKLHLVPGESGIATFELTRRDISYWDVGLQKWVVASGTFEVFVGASSRDIRLTGSFTV

SEQ ID NO: 21295 - protein, 208 aa, Phanerochaete chrysosporium
GAGGETTAGTLTFVVYFLTQHPNVLQRLRQEILDVVGPSNLPTYDDIKQMKYLRAVLNETLRLYPPVPWNMRYAVKDGILPNSEPDGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRHI

SEQ ID NO: 21296 - protein, 181 aa, Brassica napus
MASSMLSSATVVSSPAQAAMVAPFTGLKSSAAFPVTRKTNTDITSIASNGGRVNCMKVWPPVGKKKFETLSYLPDLTDVELAKEVDYLLRNKWIPCVEFELEHGFVYREHGNTPGYNDGRYWTMWKLPLFGCTDSAQVLKEVQECKTEYPNAFIRIIGFDNNRQVQCISFIAYKPPSFTGA

SEQ ID NO: 21297 - protein, 511 aa, Streptomyces avermitilis MA-4680
MTDDAMASGLSDEERLAQLGYTQVLARRMSAFSNYAVSFTIISVLSGCLTLYLFGMNTGGPAVITWGWVAVGLMTLFVGLSMAEICSAYPTSAGLYFWAHRLAPAKNAAAWAWFTGWFNVLGQVAVTAGIDFGAASFLGAYLNLQFDFEVTPGRTILLFAGILVLHGLLNTFGVRIVALLNSVSVWWHVLGVGVIVGALAFVPDHHQSASFVFTEFVDNTGWGSGPYVVLIGLLMAQYTFTGYDASAHMTEETRDAATAGPKGIVQSIWTSWIAGFVLLLGFTFAIQSYDKELNSPTGAPPAQILLDALGATAGKLLLLVVIGAQLFCGMASVTANSRMIYAFSRDGALPLSHVWHTVSPRTRTPVAAVWLAALSALVLGLPYLINYTAYAAVTSIAVIGLYVAYVIPTLLRLRKGAAFERGPWHLGRWSRLIGIVSVIWVGVITVLFMLPQVSPVTWETFNYAPVAVLVVLGFAAAWWVASARHWFLNPEHERTIARETARAGAPEPVDP

SEQ ID NO: 21298 - protein, 101 aa, Zea mays
GTLRVGRLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 21299 - protein, 440 aa, Cochliobolus lunatus
MAITKIHARSVYDSRGNPTVEVDIVTETGLHRAIVPSGASTGSHEACELRDGDKTKWGGKGVTKAVANVNDIIAPALIKEKLDVKDQSAVDAFLNKLDGTENKTKLGANAILGVSMAIAKAAAAEKGVPLYAHISDLAGTKKPYVFRFLSKNVLNGGSHAGGFLLFQEFMIAPAKTFAEALRIRQGAEVYQKLKALTKKTYGQSAGNYGDEGGVAPDIQTAEEALDLIVDAIEAAGHTGQIKIAMDVASSEFFKDDEKKYDLDFKNPDSDKSKWLTYPQLAEMYKSLAEKYPIVSIEDPFAEDDWEAWSHFYKDGDFQIVGDDLTVTNPEFIKTAIELKSCNALLLKVNQIGTISEAINAAKDAFGAGWGVMVSHRSGETEDVTIADIVVGLRSGQIKTNAPARSERLAKYNQILRIEEELGDKRLFAGNKFHTAINLYL

SEQ ID NO: 21300 - protein, 240 aa, Papaver rhoeas
EALEREGVTNVFAYPGGASMEIHQALTRSSSIRNVLPRHEQGGIFSAEGYARASGLPGVCIATSGPGATNLVSGLADALLDSIPIVAVTGQVSRRMIGTDAFQETPIVEVTRSITKHNYLVLDVEDIPRVVKEAFFLATSGRPGPVLIDVPKDVQQQLVVPKWDTPMKLPEYMSRAPKSPEHNLLEQVVRLISESKKPVLYVGGGCINYSEELRRFVDLTGIPVASTLMGLGAHSCTDVL

SEQ ID NO: 21301 - protein, 158 aa, Glycine max
  unsure (1)..(158): unsure at all Xaa locations
ALSMIASITDTTVNLAGAGLDATSTGLKPMVGCPTMKTNNDITYIANNGGRAQCMQVWTPFGSKKYETLSYLPDLDEAQSAKEVEYLIKKGWITCLEYKLDHSFLYRELKMPPXYFEGLSWSLWKVPMFGSTDTSHVLNELQYAXTAYPDSQIRIIGF

SEQ ID NO: 21302 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 21303 - protein, 179 aa, Glycine max
LFSAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 21304 - protein, 352 aa, Cochliobolus heterostrophus
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAIFPKTNDLALDLLERLLAFNPVKRISVEDALKHPYLEPYHDPDDEPGADPIPEEFFDFDKNKDNLTKEQLKLLIYQEIMR

SEQ ID NO: 21305 - protein, 345 aa, Triticum aestivum
  unsure (1)..(345): unsure at all Xaa locations
MGKIKIGINGFGRIGRLVARXVALQSDDVELVAXVNDPFITTEYMTYMFKYDTVHGHWKHSDIKLKDDKXLLFGEKPVTVFGXVRNPEEIPWGEAGAXDYVVESTGVFTDKDKAAAHLKGGAKKVVISAPSKDAXPMFVVGVNEDKXYTSDVNIVSNASCTTNCLAPLAKIINDNFGIIEGLMTTVHAITATQKTVDGPSSKDWRGGXRAASFNIIPSSTGAAKAVGKVLPELNGKLTGMSFRVPXLWDVSVVDLTVRTEKAASYDDIKKAIKAASEGKLKGIMGYVEEDLVSTDFVGDSRSSIFDAKAGIALNDHFVKLVSWYDNEWGYSNRVVDLIRHMAKTQ

SEQ ID NO: 21306 - protein, 400 aa, Nitrosomonas europaea ATCC 19718
MNPSLENLQLYPFQKLTKLFEDLVPRDSLPTPIGLHIGEPRHSTPEFIRQELINSLEGLAHYPTVLGTDRLRASIATWLTQRYHLSSIDPDTEVIPVNGSREALFSFAQAVIDTDHKAIQPAVVCQNPFYQIYEGAALLAGATPYFLNQLPENNFSADTAQLPDTVWERTQLVYICSPNNPTGKVLTLDEWKHLFDLSDRYGFVIAADECYSEIYFDEGHPPLGALEAAEKLGRSGFPRLVVFSSLSKRSNVPGMRSGFVAGDATILRKFLLYRTYHGSAMNPAVQAASTVAWSDEQHVAENRKLYYEKFTGAMHILGDTLPVSMPDAGFYLWLRTPVSGIEFSRRLYREGNVTVLPGSYLAREAHGMDPGEDFVRIALVAPVVECMEAMERIRDIARKF

SEQ ID NO: 21307 - protein, 157 aa, Zea mays; identical to SEQ ID NO: 9363

SEQ ID NO: 21308 - protein, 439 aa, Phaeodactylum tricornutum
MKMAVVAFFVIAQCGAFAPAHYSRTVTSSTLLGAKEKGGTSKELDLPCADECAISKYPNLPESIHPGVLSGQAQMDLLNHAKEHGYAIPAVNCVSNSGINACLEAARKNDAPIIIQFSSGGSQFYGGKGLDNSNYRAAIAGAVSGAFHVRTMAEQYGVPVILHTDHCAKKLLPWIDGLLSASERYYEQHGEPLFSSHMIDLSEEPIEENIEICKEYLTRMDKIGILLEMELGITGGEEDGVDNSDRPIEDLYSKPEEIYQVYEELMKISDKFTVAAAFGNVHGVYSPGNVKLEPKILSRAQDYISEKLGDKAPADKKPVAFVFHGGSGSDVADIQEAIGYGVIKMNIDTDTQWSYWEGIKNFETKYHDYLQTQIGNPDGPDKPNKKYYDPRESMRAAEVNTVARLGKSYADLKCQNILGLGEVEPADNVLGPRRGGLPV

SEQ ID NO: 21309 - protein, 157 aa, Glycine max
  unsure (1)..(157): unsure at all Xaa locations
EKSLNHVMQHVHYEDENTRYICIGPVNKVLNMLACWIEDPNSEAFKLHIPRIYDYLWVAEDGMKMQGYNGSQLWDTAFAVQAIAATDLXXEFAPXLKLAHDFIKNSQVVDDCPGDLSYWYRHISXGAWPFSTADHGWPISDCTAEGLKASLLLSKIS

SEQ ID NO: 21310 - protein, 407 aa, Microbulbifer degradans 2-40
MNPDLSKLQPYPFEKLNALKATVSAPADKSHIALSIGEPKHQPPAFALKALTDNLARFANYPSTKGLPELRTAIANWANTRFNLQRATLDAEANVLPVNGTREALFAFAQACIDSSKADAKVLMPNPFYQIYEGAAFLAGAEPVFLNCLPENGFIPDFDAISEQTWQACQLLFICTPGNPTGAVMSRELLEKLIGLADKHNFIIASDECYSELYFDEANPPTGLLEACESLGKTDFKNCVVFHSLSKRSNLPGLRSGFVAGDAHIIDQFFQYRTYHGCAMSVPCQLASIAAWQDEAHVLENRNLYRQKFDAVIEILKDVLPVSTPDASFYLWPKTPIADTDFAQQLFAQQNVTVLPGRFLARDCDGVNPGENYVRLALVAELEECIEAAHRIKAFVQSLNQTLYTNS

SEQ ID NO: 21311 - protein, 563 aa, Zea mays
MIKNSSRLILEECPRVRAKKRPRVRPRVRPRVRGAAMAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGFGIGGDYPLSATIMSEYANKKTRGAFIAAVFAMQGFGIMAGGLVAIVVSAWFKASFPAPAYAVDPAASTPPQADFVWRIILMLGAMPAALTYYWRTKMPETVEISAGAAEEGAAAATATATEPAPASASASFGLFSGEFLRRHGLHLLGTSSTWFLLDIAFYSQNLFQKDIFSAVGWIPKAATMNALEELFSIARAQSLIALCGTVPGYWFTVALVDVLGRFAIQVTGFLMMTVFMLGLAVPYEHWTTPGHHIGFIVMYGLTFFFANFGPNATTFIVPAEIFPARLRSTCHGISAASGKLGAIIGSFGFLYLAQNRDPAKTDHGYPAGIGVRNSLFLLAGCNLLGLAFTFLVPESKGKSLEEMSGENDEAAALEDPSLRTRACDVIALL

SEQ ID NO: 21312 - protein, 118 aa, Glycine max
  unsure (1)..(118): unsure at all Xaa locations
ANKETGRTNVMRGAKKEQGHQRVNYIVVVRQALREQWGGAWTKTQRXINIVLGLDDVMENLCAXVDKNEAESPPFTLYAIDYVMENDPLVYGSHYNTFGTRLIDLSMITNSLTGGDDL

SEQ ID NO: 21313 - protein, 204 aa, Methanosarcina barkeri
MSFLTVKKALIPAAGLGTRFLPATKSMPKEMLPIIDTPVIHYVVEEAIASGIEDIIIITGRGKRAIEDYFDDSPELEMHLAKKHNTELLKLVRDVSSLVDIHYIRQKEPNGLGDAVLRAENHIGDEPFAVLLGDDIIVNDKPCTAQLIENFEKYGRSTLAVEEVPYEKLSSYGIIKGKPLCDSLYMLEDIVEKPSPENAPSNLG

SEQ ID NO: 21314 - protein, 543 aa, Corynebacterium glutamicum ATCC 13032
MGDDLVQHLPGLNRRLPGVDKRNRIALSACGVLRAPENFQEEGIRRIGGNHSDEAGVLALKSLSFHTRCGFSPQWKNSLAQAAKTPATQWKGRRQRLLRHHKWWLLSRCEPQNLSCTRVYSAKEITSLDSMLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 21315 - protein, 368 aa, Oceanobacillus iheyensis HTE831
MERMMGLVNLEHEHHLLNELAYFRNPASIPFGGRYRLIDFTLSNMVNSSIQEVAIFVRNKYRSLLDHIGTGENWELDRRNGGLFILPPDWNDPTDRSRGDLKFFHNNRDYFNRSNSKYVLISGSQFISNTDYKEALEQHIKEQADVTLITVREEELSNEHESNLRVECDYIHRVQALTNDKNNPEIFTGVYIINKDLLIELVDNCIAYHKDHFFHAAIMERLGDLRVFRFRQEGYHAFINSVESFYKHNMKLLQEDSYQQLFLNNHFVRTKISNNAPVKYGEKAEVVNTLVANGCKVNGCIEGSILFRGVQLHEGATVKNSIIMQRCTIGSGVHLENVILDKDVVVTTGQRIIGSKEKPYVVAKRQVI

SEQ ID NO: 21316 - protein, 234 aa, Oryza sativa
MRRARVPISRFPVGAVGLGMSGCIYASVNLEFRGLPLSHSIHAEQFLVVNAAAVGKSKLCAIAISHMPCGHCRQFLQEIRGAGGIRIIVTSSDAKWRTVSSLLPRPFGPHDLLPKHVPLVLKPHDSPLVGNPATAVITNGFANGDLEARLREAAEAAARAAHTPYSECPSRFAVADGEGMVAAGGAAAAEDVVAAALVEKEAALVSQEAMARIFLAAVAPQASFHVYNFGLSDA

SEQ ID NO: 21317 - protein, 555 aa, Zea mays
  unsure (1)..(555): unsure at all Xaa locations
MDSVRSWFQKFQPRDKSKRPVVAARHGKDPGKPPMDDAPSSATKQRVAAAKQYIENHYKTQMKSLQDRKERRWMLERKLXDAEVPVEEQNNILKHLEKKETEYMRLQRHKMGVEDFELLTIIGRGAFGEVRLCREKVSKNVYAMKKLKKSEMLRRGQVEHVKAERNLLAEVDSAYIVKLYYSFQDEEFLYLIMEYLPGGDMMTLLMRKDTLTEDEARFYIAETVLAIESIHKHNYVHRDIKPDNLLLDHSGHLKLSDFGLCKPLDSSNFPNLNEPDYMSGKVTTPLPDTTRLSNPSAPRRTQQEQLSHWQKNRRMLAYSTVGTPDYIAPEVLLKKGYGTECDWWSLGAIMYEMLVGYPPFYSEDPMSTCRKIVNWRSHLKFPEEAKLPPEAKALISKLLCNVEHRLGTKGAHEIKAHPWFGGVQWEKLYQMKAAFIPEVNGELDTQNFENFEEIGTQIQSSSKSGPWRKMLPSKDANFVGYTYKNFEIVNDDEVAGIAELKKKSSKPKRPTIKTMFERMDEEEPVQGSFLSMLPPEGQPSSHSSVPQEKYQPRRK

SEQ ID NO: 21318 - protein, 298 aa, Thermotoga sp. RQ2
MRKAIILAGGAGTRLYPMTLVTSKQLLPVYDKPMIYYPLTTIMLAGIRDILVISTPKDLPKFKDLLGDGSQFGIHLEYAEQPQPKGIAEAFIIGEKFIGDSPCALILGDNIFFGHDLTRILKEAAQNTDRATIFAYYVDDPERFGVVEFDENGRALSIEEKPKNPKSNYAVVGLYFYPSGVSELAKTLKPSARGELEITDLNRIYLEKGLLDVKILGRGFAWFDTGTADALLEAAEFVRIVQKRQNIIIASPEEVAYRNGWITKEDLLEAAKKYRNSVYGEYLRRVAEGKIIYRRENK

SEQ ID NO: 21319 - protein, 482 aa, Geobacillus stearothermophilus
MIYVNGKWSKGEGKKRPVINPANEEIIIEINEASQQQAVEAIQAARHAFQYTDWPFNPAKRIAALRQLADLLEQNAETFASIETLNTGKPIRESRLDVSDSIQCLRYYADFVEQRAIEEIKRTDGTTSKIIEEPIGVCALIVPWNFPLLLGIWKLAPALAAGNTVVFKPSELTPLSFIELTKLIDSIGLPPGVFNLVPGGGSPVGETLVTHPDVEKISFTGGTKTGRWIYEQGARRLKRVSLELGGKSPLLIFDDADLASTIEWALFASFFNQGEVCVAASRILVQRRVYDSFLDQLTQRLASLRIGDPFAEHTEMGPLISSSHLEKVETYIQIGLQEGGVLLQGGKRMKELGYYLTPAVFAHVRQDMRIVQEEIFGPVITVQPFEHDEEAIKLANDTIYGLAAGLFSRDLERAEQIAGKLRAGTIWINSYHTPYVDAPWGGLKQSGIGRELGPQGFAAFTETKHVNISQHGKPLGWYSSHS

SEQ ID NO: 21320 - protein, 372 aa, Ipomoea nil
MPTKVSDTCRPHHPIVSQILDLYSIKELPESHAWSSDDHTGSNSINFESIPVIDLDNYNHDNNFNILDTIGHACKKWGAFQLINHNISEKLLEDIEIAGRRLFSLPMQQKLKAARSPDGVSGYGLARISSFFDKLMWSEGFTIVGSPLEHSRLLWPQDFNSFCEVVEEYEKEMKKLAGRMMKLILESLGVAEEDAKWGVESKGRCSALQLNSYPACPDPGRAMGLAEHTDSTVLTILHQNNTSGLQVFREGAAGGWVTVPPIPGALVINAGDLLHILSNGLYHSVLHRAVVNRSSHRLSVAYLYGPPPGIKISPLPKLVAEGQPPLFRAITWSEYLRTKAKHFDKALSSVRLICAPRNPFSDTNDHNRVRVG

SEQ ID NO: 21321 - protein, 199 aa, Bacillus subtilis
MTIDHSVTNTEQLEQQNPAIKTKLKLKKLKDQVIVITGASSGIGLVTARMAAEKGAKVVAAARNEEALKELTDELKEKGHDAIWVKADVGKEEDVNRIAETAISTFGRFDTWVNNAAVSTFGHAMDVTVEDMKRMFDTNFWGPVYGTRAAVKHYTGRGVPGALINVGSLFGDRGTVIQSTYASAKFALHGWTESIRMEL

SEQ ID NO: 21322 - protein, 276 aa, Glycine max
  unsure (1)..(276): unsure at all Xaa locations
AYSNLVVGLNDTMENLLAAVDRNEAEISPSTLYAIACVMENVPFINGSPQNTFVPGLIDLAIARNTLIGGDDFKSGQTKMKSVLVDFLVGAGIKPTSIVSYNHLXNNDGMNLSAPQTFRSKEISKSNIINNMVNINTILYEPGEHPNHIIIIKYVPYVGDSKRAMDEYTSEIFMGGKNTIVLHNTCEDSLLAAPIILDLVLLAELSTRIQFKAENEGKFHSFHPVATILSYLTKAPLVPPGTPVVNALSKQRAMLENIMRACVGLAPENNMILEYK

SEQ ID NO: 21323 - protein, 1274 aa, Oryza sativa (japonica cultivar-group)
MVFKGRFFSSRHKSSESSSPTDGSNSPRTPTSAPPAAGSPAAASSSSSSRSDKKKPKSETPRKRDKLFGGSASGSAASKGGAGAAPASASSSPSADGRKAAAAQLRDGGAGGASAAALSPILASSLGLNRIKTRSGPLPQEGHRIAAALGSSNLSRGQAQADPSAASAGGGGGGGRKAGSSWADSTSGSRGKGKAAEHPARGATATSLEGKSSAKDVLSYKEIGAHDFHFAAWCLDAKLGTTGANCAYDPCETPKESESPRFKAIMQATSAPRKRVPADIKSFSHELNSKGVRPFPFWKPRGIYNLKEVLKVIQVRFEKAKEEVNSDLAVFAGDLVGVMEKYADSHPEWKETLEDLLILARSCCVMTPGEFWLQCEGIVQDLDDHRQELPMGVLKKLYTRMLFILTRCTRLLQFHKESGFAEDEVVMDQRDKIIQSADRQILAQPGDDTTTRGSKSDVRKSYSQEQHNLKWKRSQEIKPVKFLSPLDTTDVKKEVESPTRERISSWKPFPSPVPKPPKDPTPIKEESPNKKTDTPPAVSSQAELNSPVESTSHQSLPPKHQHKTSWGHWSDQPNISEEGSIMCRICEEYVPTHYVENHSAICASADRCDQKGVSVDERLIRVAEALEKLVESYTQKDLPNAVGSPDVAKVSNSSINEESDGPSPKLSDWSRRGSADMLDYLQEADSTISLDDIKNLPSMTCKTRFGPKSDHGMATSSAGSMTPRSPLTTPRSNHIDMLLAGRSAINESDDLPQIVELADIARCIATTPLDEERALSLLVTCIEDLQEIVNRRKHEALTVQTFGTRIEKLHREKYLLLCDSVDMDKVDSASTVMDEEDDVVRSLRASPVHPVKDRTSIDDFEIIKPISRGAFGRVFLAKKRTTGDLFAIKVLRKADMIRKNAVESILAERDILITVRNPFVVRFFYSFTSRENLYLVMEYLNGGDLYSLLRNLGCLDEDVARIYLAEVVLALEYLHSMHIVHRDLKPDNLLIAHDGHIKLTDFGLSKVGLINSTDDLSGPAVSGSSLYGDDEPQMSEFEEMDHRARRQKRSAVGTPDYLAPEILLGTGHGTSADWWSVGVILFELIVGIPPFNAEHPQTIFDNILNRKIPWPHVPEEMSSEAQDLIDKLLTEDPHQRLGANGASEVKQHQFFKDISWDTLARQKAAFVPSSDSAFDTSYFTSRYSWNPSDENIYEAYEFEDSSDNGSLSGSSSCVSNHQDDMGDESSGFTEFESSSNVNYSFSNFSFKNLSQLVSINYDLLTKGLKDDPPTKSET

SEQ ID NO: 21324 - protein, 226 aa, Rhizobium etli
MNPMQADAKQLLQEFKQLLQENEITEEKCNIGLAPVTLALTSTQAELANAARSVFTVAQDVSRFGNMGAYTGEVSAELLKDSQIEYVLIGHSERREYFAESAAILNAKAQNALNAGLKVIYCVGESLEQRESGQAEVVVLQQICDLASVVTAEQWPHIVIAYEPIWAIGTGKTASPEDAQTMHAKIREGLTQITSHGANMAILYGGSVKAENAVELAACPDINGAL

SEQ ID NO: 21325 - protein, 213 aa, Zea mays
  unsure (1)..(213): unsure at all Xaa locations
GLSLAESGGFVKAPGGAPANVACAIAKLGGSSAFVGKFGDDEFGHMLVNILKQNNVNSEGCLFDKHARTALAFVTLKXRLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTT

SEQ ID NO: 21326 - protein, 371 aa, Triticum aestivum
  unsure (1)..(371): unsure at all Xaa locations
MASSEVVEDEASAAAMLANGAADVRRRRDQAKAMLSKQAVKIATKAEEHERFIFKVTHLMGVLGFGTFCYLLGARPQDVPYVYCLFYVIFVPLRWIYYRYKKWHYYLLDFCYYANTFLLVMILFYPKDEKLFMVCFSFAEGPLAWALIVWRCSLVFSSFDKLVSVLIHLLPGIVLFTIRWWNPQTFAAMHPEGRAARVTWPYVEDKSYLWTWLFVVPLAAYTLWQLMYFLIVNVLRRQRXLLRDPEVMTSYRELSKKAQKANNIWWRLSGLLGDKNRPLMYILLQALFTVATLAFTVPIFLSYRLHGIFQVLKVCAATWNGGSFILEVMPRQVVQKEKKRLEMKPIEQANLKEHMDDPSGNHQHASEEPSQ

SEQ ID NO: 21327 - protein, 838 aa, GIBBERELLA ZEAE PH-1
MSLEAIMMEVDEQGKRNCSGDAAVKPDTGKKLEVQLVLSLAIGISAFFLFCFLRPRWPSLYAARKRRLDHRLGLPALPNSTFGWIPTLFRITEEQVLASAGLDAFVFLSFFKMAIRLLVVMAFLATVILWPINYIYEGFRLPVGGNKDTKAVNLDAFYNNPSYIDVLKDKDDGKDKSWIKTWMWAYVFFTYFFVGLTIYYLNHETHRIIKFRQDYLGSQSTVTDRTFRLTGIPEDLRSEEAIKNLIEKLEIGTVEKVMICREWKKLDDLMDARETALRSLEGAWATFLKHQRQKRKDNWPQRRRGNGVSPNGPQDSGDNETAGENGQLLDPEQQPWDSGDEGRPKVNIRYGTLGLRSRNVDAIDYYEERLRRLDAKVTEARKKSYTPTDMAIVTMDSVASCQMAIQARIDPRPGRLLTKLTPAPSDLVWRNTYARRGIRRLKSWTVTILITIVTLVFITPTAFLAASTGLPALVVSLLNVAVPYLYDFLSNHQGMISQGDVELSVISKNYFFTFFNTFFVFAISTSGLAWWSELQKFAKDTSKIPGAIARDVEELAIFYICFIMLQGIGLMPFRILEAGSVFLHPFLKWLSKTPRDALELKKPPVFQYGFFLPTSLLVFNLCIIYSVLNLGFIILIIGLIYFVLGYFTFKYMVLYAMDQPQHATGGAWRIICYRVVVGLLVFELVMVGRIATGEAFIQSACILPLIPFSVWYSFYIKRRYEPLTKYIALRAIRAEEDSDDAAAMDDAFEDEDVARPSQTLLRRGSTLDEYKEKGMQFINPSLVAPLPQPWIYDEPPPPIVTDDTQSTEESQRPILQGVDSTLGIGDENVWRDNGGNNV

SEQ ID NO: 21328 - protein, 576 aa, Arthrobacter globiformis
MTIEETEEEATYRAGREWFKSAVVYQIYPRSFADSDGDGVGDLRGIIGKLDYLQKLGVDVVWLSPVYRSPQDDNGYDISDYREIDPVFGGLETLDELLDGLHARGMKLVMDLVVNHTSDEHPWFVESRSSKDSPKRDWYWWRPAREGAEPGTAGAEPNNWGSAFSGPAWEYDAATGEYYLHLFSRKQPDLNWENPEVRAAVYDMMNWWLDRGVDGFRMDVINFISKDQTLPDGPRADGMLFGDGGPHYICGPRIHEFLQEMHQEVFAGRDKDLLTVGEMPGVTVDEAVLFTDPGRREVDMVFQFEHVALDQEGGNKWRPKKLLLTDLKKSLGRWQEALGERGWNSLYWGNHDQARAVSRFGDDGEYREQSAKMLAAVLHLHRGTPYVYQGEELGMTNMAFGAISDYRDIEVLNHHREATTHLGHTDAEVLAALAPLNRDNARTPVQWDASRHGGFTTGAPWIAVNPNANTINAAAQVDDPDSVFSFYRRVIALRHADPVVAYGDFTMLLPDDEHVYAFRRSLPDAELLVLGNFSGTGQSAGVDGSWGDAELVLGNYPAAPGLGLRPWEVKVFRRNL

SEQ ID NO: 21329 - protein, 320 aa, ASPERGILLUS NIDULANS FGSC A4
MPLSLLLKASPFIDELALYDVVNTPGVAADLSHISSVAKISGYLPKEDGLKNALTGTDIVVIPAGIPRKPGMTRDDLFKINAGIVRDLVKGIAEYSPKAFILIISNPVNSTVPIAAEILKAAGVFDPARLFGVTTLDVVRAETFTQEFSGQKDPSAVTVPVVGGHSGETIVPLFSKVSPAFQIPADKYDALVNRVQFGGDEVVKAKDGAGSATLSMAFAGFRSGILFAESVIKASKGQSGIVEPSYVYLPGVPGGADIAKATGVNFFSTPVELGPNGVQKAINILDGITDAEKKLLDTAIKGLKGNIDKGVEFAQSPPPK

SEQ ID NO: 21330 - protein, 574 aa, Neurospora crassa
MADLAEPEISLPVSGLSHKSEGAPSTDGEAILTPDTPSTPPLNSSPGEHDPNTPTLDVTTPKSPAVLSRNSSFSGSISSTLHDEWDVFPPLDRLTVLDLLDNFALPQQLEKLQRGIHARTEKMRKSGEALKEKSAIARERMVDEWRKRVPTAEEQLERYKKRMRVNVDKLGKRWNDTKVITLREKVAFIFGVMNIFISGYLIGAFPEWFHIWYTVQILYFMPIRFYRYHKQGYHYFLADLCYFVNFLLLLSLWVFPGSKRLFTAVYCLAYGNNAIAIIMWRNSLVFHSLDKVTSLFIHIMPCATLHCIVHLLDPAEQRKRFPSIWTIKTSPPGSPTAYANVISMLAWSTIPYAIWQLAYYFFITVRRRDKIAAGRPTSFTWLRKSYSKNWLGKAILNLPDSLQEPAFMLIQYTYAVLTMLPCPLWFYYRWLSAVFLMGVFTWSVYNGSTYYIDVFGKRFQKELEAMKAEVAKWQHSPDGMVHSPTLTPHAGAQEEENKRLGEPTKNNNNSDSNDSSGSSTSSLDNIPLLTEEKSELPASATATATGAEVDGGAKDVARARRPGAELFGAGAAPS

SEQ ID NO: 21331 - protein, 115 aa, Zea mays
GWHMIIGGLPLLVISVLNHDPALSGHIQDLTWSDILALGYTSIFGSAVSYGVYFYNATRGSLTTLSSLTFLTPMFASVFGYLYLGETFSPVQIGGALLTLVAIYMVNYKSIIGEK

SEQ ID NO: 21332 - protein, 113 aa, Glycine max
CFREKYQNSNIEIHTFNQSQYPRLVVEDFLPLPSKGHTDKDSPTRPGHGPVFPSLLNSGKLDALLSQGKEYVFVANSDNLGAIVDLNMQYLLQYKLDVVLTQLITLEMSISAP

SEQ ID NO: 21333 - protein, 365 aa, Zea mays
MRRHMAPIKEQKHTTSAEQQVMLDAELQLWNHTFGYVKSMALKAAIDLGIPEAIHQHGGTATLPQIVTRVTLHPSKTPCLRRLMRVLTLTGVFGAQEAHDDDGGCDDELVYTLTPASRLLVGSPGQNVGPFLTVMLGPIFMSSFLDLRGWFQHETPDPSPFKMTHGRDIWELAAHDAAFGRLFDAGMVADSSFIMDVVVRECGGVFEGISSLVDVAGGLGGATQTIAKAFPNLECSVLDLPNVVASAPTDTAVKYVAGDMFESVPAADAVFLKGDADCVKILKNCKKAIPAQGGKVIILDIVVGAGSSCDRKNVETQCLFDLFIMFINGAERDERQWKKIIFEAGFTSYKIIPVLGIRSIIEVCL

SEQ ID NO: 21334 - protein, 389 aa, Nostoc sp. PCC 7120
MKAMILAAGKGTRVRPITYTIPKPMIPILQKPVMEFLLELLRQHGFDQIMVNVSHLAEEIENYFRDGQRFGVQIAYSFEGKIDDEGKLVGEAIGSAGGMRRIQDFSPFFDDTFVVLCGDALIDLDLTAAVKWHKSKGSIATIITKTVPEEEVSSYGVVVTDENSRVKAFQEKPSIEEALSTNINTGIYIFEPEVFNYIPSGVEYDIGGQLFPKLVEIGAPFYAIAMDFEWVDIGKVPDYWRAIRGVLQGDIKNVQIPGHEVAPGIYTGLNVAVNWDKVDITGPVYIGGMTRIEDGAKIVGPAMIGPNCWICGEATVDNSVIFEWSRLGHGARLVDKLVFGRYCVDKTGAAIDVQAAALDWLITDARQTPPEHTPVERQAIAELLGTNAT

SEQ ID NO: 21335 - protein, 313 aa, Oryza sativa (japonica cultivar-group)
MAANFSACLVPVAVLALFYLVIFPNDLSQLKSALAPCDAASKSVAAAAAADDDVDFRMFFGILTRPDFYERRALLRMAYALQPPPRRAAIDVRFVMCSLDKEEDAVLVAMEIITHGDILVLNCTENMNDGKTYDYFSALPRLFPAGAEPRYDFAGKIDDDTYYRLGALADTLRRKPRRDMYHGFLNPCHIDPAWQYMSGMGYIVSWDVAEWIAASPELRGREIGYEDDVFGRWLRGAGKGKNRFGEEPRMYDYLDREMYGADVNCFRHELIADTVAVHKLKDRLKWARTLRFFNATDGLKPSKMYHVDLTPRI

SEQ ID NO: 21336 - protein, 237 aa, Oryza sativa
MAGIRLTPEEPELPQGTPPRPQLPPAFAGAGAVLAGSGSGGGGGLEMASDDERSVAADSWSVRSEYGSTLDDDQRYADAAEVLAAAAASANFPSGASDCCLMIAFRIVIKYVERGSARDVFASFVVIGQVGIGSQMRIQIDCVLTKMIKILARLKAQCWGSKVIGMLLIQKILQIFRNMGMLEKYDIINGGTPSGNESINCEVDEKQLSNYPVLDVGTGNGLLLQALAKQGYNLMFS

SEQ ID NO: 21337 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 21338 - protein, 409 aa, Triticum aestivum; identical to SEQ ID NO: 6248

SEQ ID NO: 21339 - protein, 428 aa, Shigella flexneri 2a str. 301
MKIATIKTGLASLAMLPGLVMAAPAVADKADNAFMMICTALVLFMTIPGIALFYGGLIRGKNVLSMLTQVTVTFALVCILWVVYGYSLAFGEGNNFFGNINWLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSVGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 21340 - protein, 160 aa, Zea mays
  unsure (1)..(160): unsure at all Xaa locations
LAESQCDPTKXRACRSHDTTVTTTNAXGAPVGNDNEVLTCGXPRGPMLLEDYHLSEKVAHFSFXRMLERVVHAPGASAKGFLQCTHXDMTSVTCADFLRAPDXTTPVIVRFXVSDPXRTSQETMRDPRGMAAKPYTRDDNWDLVGTNLRDLFIRYGMKFR

SEQ ID NO: 21341 - protein, 338 aa, Zea mays
  unsure (1)..(338): unsure at all Xaa locations
MGKIKIGINGFGRIGRLVARVALQSEDVELVAVNXDPFITTDYMTYMFKYDTVHGQXKHSDITLKDSKTLLFGEKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIIEGLMTTVHAITATQKTVDGPSAKDWRGGRAASFNIIPSSTGAAKAVGKVLPELNGKLTGMSFRVPTVDVSVVDLTVRIEKGASYEEIKKAIKAASEGPLKGIMGYVEEDLVSTDFTGDSRSSIFDAKAGIALNDHFIKLVSWYDNEWGYSNRVVDLIRHMFKTQ

SEQ ID NO: 21342 - protein, 563 aa, Eremothecium gossypii
MSEITLGRYLFERLKQVEVRTIFGVPGDFNLSLLDKVYEVDGMRWAGNANELNASYAADGYARVKKISCLVTTFGVGELSALNGIAGSYAEHVGVLHVVGVPSTSAQAKQLLLHHTLGNGDFTVFHRMSANISDTTAVITDISSAPAEIDRCIRACYVHQRPVYLGLPANMVDLTVPASLLNTEIDLSLKPNDPEAEEEVVSTVLELVANAKHPVILSDACASRHDVKQETKQLIDVTQFPAFVTPMGKGSIDEQHPRFGGVYVGTLSAPDVKEAVESADLILSVGALLSDFNTGSFSYSYKTKNIVEFHSDHTKIRSATFPGIKMKTVLQNLVKRIGEAAKGYQPSPVPTYAAPNEDADPKTPLKQEWLWNQVSSFLKEGDIVITETGTAAFGINQTRFPSSTIGISQVLWGSIGFTTGACLGAAFAAEEIDPNKRVILFIGDGSLQLTVQEISTMVRWGLKPYLFVLNNDGYTIERLIHGETAQYNCIQPWKHLDLLPTFGAKDYETHRVATTGEWRALTEKQEFNKNSSIRMIEIMLDVMDAPSSLIKQAKLTAATNAQP

SEQ ID NO: 21343 - protein, 256 aa, Brucella melitensis 16M
MTKFWIGTSWKMNKTLAEARLFAEALKAADAGRSPDIQRFVIPPFTAVREVKEILSGTSVKVGAQNMHWADQGTWTGEISPLMLKDCNLDIVELGHSERREHFGETNETVGLKVEAAVRHGLIPLICIGETLEDCESGRAAAVLEEEVRGALSKLSEAQKQAEILFAYEPVWAIGENGIPASADYADARQAEIIAVAQSVLARRVPCLYGGSVNPGNCEELIACPHIDGLFIGRSAWNVEGYLDILARCATKVQAN

SEQ ID NO: 21344 - protein, 324 aa, Triticum aestivum
  unsure (1)..(324): unsure at all Xaa locations
MGVKGFVEGGIASIVAGCSTHPLDLIKVRMQLQGESSAAXAAPQPALRPALAFQAGAHTVTLPHAPTPVPKPGPIGICTQILRAEGAAGLFSAISATMLRQTLYSTARMGLYDILKNRSTQENGGVLPLHLKIAAGLIAGGVGAAVGNPADLAMVRMQADGRLPLAGRRNYRSVGAAIARMTRDEGVRSLWRGSALTVNRAMIVTASQLATYDQAKEAILARRGPAADGLGTHVAASFAAGIVAAAASNPVDVVKTRVMNMKVAPGAPPPYAGALDCALKTVRSEGVMALYKGFIPTVSRQGPFTVVLFVTLEQVRKVFKDAEF

SEQ ID NO: 21345 - protein, 494 aa, Triticum aestivum
  unsure (1)..(494): unsure at all Xaa locations
MDPYKHRPTSGANAGYWTTNSGAPVWNNNNALTVGQRGPILLEDYHLIEKLAQFDRERIPERVVHARGASAKGFFEVTHDVSQLTCADFLLAPGVQTPVIVRFSTVVHERGSPETLRDPRGFAVKFYTXREGNFDLVXGNNMPVFFIRDGMKFPDMVHAFKPSPKTNMQENWRIVDFFSHHPESLHMFTFLFDDVGIPLNYRHMDGFGVNTYTLISRDGKAHLVKFHWKPTCGVKCLLDDEAVTVGGTCHTHATKDLTDAIAAGNYPEWKLFIQTIDADHEDKFDFDPLDVTKTWPEDIIPLQPVGRMVLNKNIDNFFAENEQLAFCPAVTVPGIHYSDDKLLQTRIFSYADTQRHRLGPNYLMLPVNSPKCAHHNNHHDGLMNFMHRDEEVNYFPSRFDPTRHAEQYPIPPRVLSGCREKCIIKKENNFKQAGERYRSFDPARQDRFLQRWVDALTDARVTHEIQGIWVSYWSQCDASLGQKLASRLKMKPNM

SEQ ID NO: 21346 - protein, 204 aa, Saccharomyces cerevisiae
MSRNSAAGLENTLFQLKFTSKQLQKQANKASKEEKQETNKLKRALNENEDISRIYASNAIRKKNERLQLLKLASRVDSVASRVQTAVTMRQVSASMGQVCKGMDKALQNMNLQQITMIMDKFEQQFEDLDTSVNVYEDMGVNSDAMLVDNDKVDELMSKVADENGMELKQSAKLDNVPEIKAKEVNVDDEKEDKLAQRLRALRG

SEQ ID NO: 21347 - protein, 364 aa, Burkholderia multivorans
MHAGLPTMTTPQDIIRRDVLAMTSYPVPDASGFVKLDAMENPYPLPEPLAAALGERLARVALNRYPAPRPAALLDKLRHAMGVPGTCDVLLGNGSDEIISMISVACAKPGAKVLAPVPGFVMYELSARFAQLDFVGVPLKADLTLDVDAMLAAIAEHRPAIVYLAYPNNPTGTLYDDADIERILRAATHSLIVIDEAYQPFAQHSWLPRAGEFDNVVVMRTVSKLGLAGIRLGYLVGRPAWLNEFDKVRPPYNINVLTQATADFLLDHLDVLDAQAAELRAERARLAQAVAALPGATVFPSAGNFLLVRVPDAAAVFDALLTERVLVKNVSKMHPLLAECVRLTVGSPDENARLLAALKLALPD

SEQ ID NO: 21348 - protein, 622 aa, Escherichia coli CFT073
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANPEVLHALNPMWAVHFFLEYKTVSFIALGAVVLSITGVEALYADMGHFGKFPIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVILLTLRTEDAPYVHNVRRVQIEQLSPTFWRVVASYGWRETPNVEEVFHRCGLEGLSCRMMETSFFMSHESLILGKRPWYLRLRGKLYLLLQRNALRAPDQFEIPPNRVIELGTQVEI

SEQ ID NO: 21349 - protein, 308 aa, Streptococcus pneumoniae
FGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEM

SEQ ID NO: 21350 - protein, 187 aa, Glycine max
MSDTEDHAASEYSNGDESPPKPRQRFRDRSKEMLSKQAVQTKQMLSKQAVKIAKQAEEHERFINKVTHLVGVLGFGGFCFLLGARPQDIPYVYCLFYVIFVPLRWIYYRFKKWHYYLLDFCYYANTIFLVDLLLYSSNEKLFMVCFSFAEGPLAWALIVWRCSLVISSVDKIVSVLIQSSIDNRDGK

SEQ ID NO: 21351 - protein, 323 aa, Oryza sativa; identical to SEQ ID NO: 16781

SEQ ID NO: 21352 - protein, 364 aa, Hordeum vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHYSSLLAAYLDCQKVGAPPEVSARLTAVAQDLELRQRTALGGLGTATEPELDQFMEAYHEMLVKYREELTRPLQEAMEFLRRVETQLNSLSISGRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 21353 - protein, 542 aa, Lotus corniculatus
MAARTLSYLLSRSRSLSSSSGAASLLPSLGGKSGGWRNSNNRYSTAAVVEELITPQVSINYTQHLINGKFVDAASGKTFPAYDPRTGDVIAHVAEGDAEDVNRAVAAARKAFDEGPWPRMTAYERSRILLRFADLVEKHNDEIAALETWNNGKPYEQAAKAEVPTFVRLFRYYAGWADKIHGLTVPADGNYHVQTLHEPIGVAGQIIPWNFPLLMFAWKVGPALACGNTIVLKTAEQTPLTALVVAKLLHEAGLPPGVLNIVSGYGPTAGAPLASHMDVDKLAFTGSTDTGKVVLGLAAKSNLKPVTLELGGKSPFIVCEDADVDKAVELAHFALFFNQGQCCCAGSRTFVHERVYDEFLEKSKKRALRRVVGDPFKKGVEQGPQIDTEQFEKILRYIKSGIESNATLECGGDRLGSKGFYVQPTVFSNVQDDMLIAQDEIFGPVQTIFKFKEIDEVIRRANSTRYGLAAGVFTQNLATANTLMRALRAGTVWINCFDVFDAAIPFGGYKMSGIGREKGIYSLHNYLQVKAVVTPLKNPAWL

SEQ ID NO: 21354 - protein, 128 aa, Oryza sativa
MADPELEAIRQRRMQELMAQRGAANPQNAGQQKAQEDAKQEAEERRQMMLAQILSSEARERLSRIALVKPDKARGVEDVLLRAAQSGGISEKVSEERLISLLEQINTHTSKQTKVTIQRRRSVLDDDD

SEQ ID NO: 21355 - protein, 478 aa, Bifidobacterium longum NCC2705
MTELKSKEDVEALINKEGIEYVSVRFTDLIGVQQHFTVPASEFLKDAFTDGMPFDGSSVQGFQAINESDMKLVPDVETSFVDPFRKHKTLDVAFSIVDPLTDEPYSRDPRQVAGKAEAYLKSTGIADTASFAPEAEFFIFDKVRFENGMNRSFYEVDSIEAPWNSGVDVEEDGTPNIGFKNRVKKGYFPVPPIDHTQDLRDDMVANLQKVGLILERSHHEVAGAGQQEINYRFNTLQHAGDDLMKYKYVVHETAALAGKAATFMPKPIADDNGTGMHCHQSLWKDGKPLFYDEKGYAGLSDLARWYIGGLIKHSSSVLAFTNPSLNSYHRLVPGFEAPVNLVYSARNRSAAIRIPLAGTSPAAKRIEFRAPDPSCNPFLAFSAQLMAGLDGILNHIEPPEPVDKDLYELPPEEHAGIKQVPSSLAEAMDALEEDHDFLTAGDVFTDDLIETWIGLKRDEIDQARLSPTPLEYELYFHI

SEQ ID NO: 21356 - protein, 329 aa, Pseudomonas putida KT2440
MSEHSSLPRLSIATLGGTVSMRAGAVGDGVTPSLDCERQLLQVPQLREMAQLNVASLCLLPSASLGFATLLEVLAWARGEVERGAQALVLSQGTDSLEETAYFLDLLWPFDVPLVMTGAMRSASQPGNDGPANLLAAAQVALAQDSRGRGVLVVMNDQVHCAARVRKTASLAMAAFESPGCGPLGDVVEGVVLYRHPPGRRKVLPLPYRTDQRVALLEACLDADTALLQAVATLGYEGLVIAGFGAGHVSASWSEVLEHLAPTLPVMVATRTGRGLTARATYGFAGAEIDLQKKGVYMAGQLCPRKCRILLWLLIGTDRQHELQDWLQP

SEQ ID NO: 21357 - protein, 339 aa, Glycine max
MGLSSKQVSSSGLDWKQTLLEAQNLELPKPNLMRKQQQQQQQQQQQTQPNSESLKCPRCDSTNTKFCYYNNYNKSQPRHFCRACKRHWTKGGTLRNVPVGGGRKNKRVKKSITPITTSSTTTTPITTATSTCTATVTTSIGNNNNNMDAMLGCYSHMTIQTPLADDQKNMSSSLYQALIRPPPLLLQQQNLLNTRELEGKDFGIGIGNGNNGIFPSSTLALPIPHQSQSLLFPFSASSRSFDTNPCSVVSTSLRSSNVYNYGEDQFKAIEEPTINSTTATIVPSTGGTNNTHHPWEIAAATSGVGLGTSSNSNYWNWEDFDSLVSTDLKDPWDDSDIKP

SEQ ID NO: 21358 - protein, 631 aa, Zea mays
MFSWNRKQSSSSGSPSPSSSSGRRRGGADASMDSSSRGGGGSGSGSGSRGRSPRLDRRNAVKRVDYEAGAGAGASVSVAASWSSSSSADQQRSPGPGLQPSRSLDVAPGADLRISGSVEGEVDELCRSLGLSGPEDFAIPVAAWEARKSRSNSDLLPRSHPDPSTPADEPSPIARVVSAPDVQPTRFVPAPIPATVAAPEESPKAAPAVAVAAPVGGLPLPSPRRGGGEVGIRGARPPLLSPPPPIGALAPPPVRRSFVDDDMTRSAWDIVQSFAPREQGSEPGERLDTRCNSDTEEESEAEDGVAAVEGELKELRIGETFEGLTGTSSLSTTNDDDASSTTTEAMFIISPNGKFKRKIKSWMRGALLGSGSFGMVYEGISDEGAFFAVKEVSLLDQGSNAQQSIVALEQEIALLSQFEHENIVQYYGTDKEESKLYIFIELVTQGSLSSLYQKYKLRESQVSAYTRQILNGLVYLHERNVVHRDIKCANILVHANGSVKLADFGLAKEMSKINMLRSCKGSVYWMAPEVINPKKMYGPSADIWSLGCTVLEMLTRQIPFPNIEWTNAFFMIGRGEQPTIPCYLSKEAQDFIGQCVRVDPESRPSASQLLEHPFVNRPLRASFESSSPPAI

SEQ ID NO: 21359 - protein, 543 aa, Saccharomyces cerevisiae
MMDSSSKSLTQYIPSPMGSLSRLKQKGVDNFQKVKKSGKSIYNYNYSKFVPHPFSTIDESVKHSESGRYDDLEIIRPTKEKEVTSSVYKRNSGKSLNTESQFSLGDSDAATLVNSVATFKLNNASTSTSLVSSSSTVCSQAKSSLRSPTSRLNDTKIKEENNYISSVKDYCGPMRKSMVKTEILIEEPLNPTTDIKSFINSYNHGKAYSLGETQHLHYYQLPFPWRENRYIIHGYRFYNTHSKSLLSIFNWYGWHNETSNIWSHLLGAIYIIYLAIYDFPQSEVWRNSQVPPQARWIVFMFLAAALKCMLSSVFWHTFNGTSFLKLRSKFACVDYSGITILITASILTTEFVTMYSCYWAMYTYMSISLALGVFGVFMNWSPRFDRPEARPLRIRFFILLATMGVLSFLHLIFLTDLHYAATLFSPVTYKSVVWYLVGVVFYGSFIPERFRSDVQVDKTIPTNYELSTDLEIITKQREIHFREVPTAHSKCSSCPSHAKSFKSLWWVDYFGCSHTFWHFFVVLGVIGHYRAILDMFAKRWILS

SEQ ID NO: 21360 - protein, 281 aa, Glycine max
  unsure (1)..(281): unsure at all Xaa locations
MAATSSLCSSTLQSQINGFCLHKTSLSHPRSLTFSRKKISTTVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAXKAGVVLNPATPLSAIEYVLDVVDLVLIMSVNPGFGGQSFIESQVKKISDLRRVCAEKGVNPWIEVDGGVGPANAYKVIEAGANALVAGSAVFGAKDYAEAIRGIKTSKRPEAVAV

SEQ ID NO: 21361 - protein, 1341 aa, GIBBERELLA ZEAE PH-1
MTESSPRAVRFQGSEDDGRPDKVRGHRLETPIESNGDPHATERHDELGNLIGYGATGHTGSLTSLAPGTVINGVSKAQRGPNTGDDGTAYTPNGSWPQRPLGPARTPSNTYNPATSRKPAHPPATPSFTESIRSSSKTRPRNESRFRAQERAYVQKLRQDYSGGYFTSYSNLNGNDSDSEGETPSSEGPYDDRFDQETIMFYGNDTLQPTDEDLKDPENRERLEWHGMLEAVLTGDVVRQEKKRLIGSADQQAGKSAHKTELWLGIRSKVCGRHIPVQRRMLEESRSTLDRTLDEIINFQIKGESEAGKPPYEQVKDMVAKIQMCENLYPSWAALATEHKAADSATFKESHDAIISWYNTNEMINTELNILKKWVGNEELDFTRTKQRSPAVNGINNDETSFLDRLMKEDGLQSLYNDDNGNLEKGMLAPISTVISKAKDTLIRNSEAFRKRHLPPYLEELLTLISFPSRLIEEITRLRLAYARRVKESAQQNPLMQDQMISQFQLLLKFAIRIKIECTSIANPEPGWDLPPCIDESFDQVVLEALKYYFKMLNWKLSGNKNTFKEAELLFQEWDFANEIGSHLQRGHIEVAEQFSSLTFKALHRLSQTFEKELQAKPKETATEMSKRYKACLDSVRVRQRMLQRFTRMLNDNYEHASDYSISFPPETMQKFYDQLVASGHFQVDTRLLEQDNIYVIASPELRERLEDIQAMMAITSKDQFPDELGEQYLLILRPEDPLNWFGETIEVPLRDLNIDLKRGHIRLCASSPQTLHNARRAFIENVDMHVDLVQEARSNIQKVNSRLTEIRRVAYKLSNNFMDSVEIIRKQARGKDCQELIQTCFVFATEFGQRSLLYMDSNRRQMNNLKLTKLALDWVSFICDDCVASDRKTFRWAVLALELAMGMTRGRHILALGEGEYAKLRSKVAGCMSLLISHFDVMGARSNLAAQAEKERIEALVGQFRKLDKNRMMNDEEASRCVTEQRMSELERVDEYRCEKIAERQGVGRVLEGNNEVDRSLAYLSSSATNVTMRWQQGQFVGGGTFGNVYAAMNLDTGHLMAVKEIRLQDPKLIPQVAEQIREEMGVLEVLDHPNVVSYYGIEVHRDRVYIFMEFCSGGSLANLLEHGRIEDEQVIMVYALQLLEGLVYLHESGIAHRDIKPENILLDHNGIIKYVDFGAAKWIARQGRTLAGDVQPSLPNRSMTGTPMYMSPEVIKGENPGKPGAVDIWSLGCVILEMATGRRPWAQLDNEWAIMYNIAQGNPPQLPPSDQLSPQGLDFLKRCFTRDPRNRSSAVELLQHDWITSIRSQVVEPATPSDTSSSAQSTPTVGSISSKLGGSDGFY

SEQ ID NO: 21362 - protein, 63 aa, Pfiesteria piscicida
MRGILVDWLVEVHLKYKLKAETLYLTVNLIDRYLEVQQVVHGELQLVGVTAMLIASKYEEIYP

SEQ ID NO: 21363 - protein, 465 aa, Gelidiella ligulata
AKMGYWDPDYQVKETDVLALFRVSPQPGVDPVEASAAVAGESSTATWTVVWTDLLTACDLYRAKAYKVIEVPNTTDQYFAYIAYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEAVNRSIAATGEIKGHYMNVTAATMEDMYERAEFAKALGTVIIMIDLVIGYTAIQTMAIWARKNDMILHLHRAGNSTYSRQKIHGMNFRVICKWMRMAGVDHIHAGTVVGKLEGDPLMIKGFYNTLLLPYLKMDLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADYVETPTANV

SEQ ID NO: 21364 - protein, 251 aa, Zea mays; identical to SEQ ID NO: 17705

SEQ ID NO: 21365 - protein, 337 aa, Hypocrea koningii
APIKVGINGFGRIGRIVFRNAVEHPDIEVVAVNDPFIETTYAAYMLKYDSSHGLFKGEVEVDGKDLVVNGKKVRFYTERNPADIKWSETGAEYVVESTGVFTTTEKAKAHLVGGAKKVIISAPSADAPMYVMGVNESDYDGSADVISNASCTTNCLAPLAKVINDNYGIVEGLMTTVHSYTATQKTVDGPSAKDWRGGRGAAQNIIPSSTGAAKAVGKVIPALNGKLTGMSIRVPTANVSVVDLTVRIEKGASYEEITETIKKAADGPLKGVLAYTGDDVVSSDMLGNTNSSIFDIKAGISLNKNFVKLVSWYDNEWGYSRRVLDLLAHVAKVDASK

SEQ ID NO: 21366 - protein, 72 aa, Zea mays
MSIQKIFARTIFDSRGNPTVEVDLTTSKGLFRAAVPSGASTGIYEALELRDGDKANYHGKSVNKAVSNVNDI

SEQ ID NO: 21367 - protein, 129 aa, Oryza sativa
MGYLDEQFNQLEELQDESSPNFVEEVAALFFKDSSRLLTNIEQAIDKYPQDFYRLDSLVQQLKGSGSSIGALRMKNECSVFKVNCNDRNLEGSLQKMKREHATLKQKLESYFQLLRQVGPRDYAVSSRK

SEQ ID NO: 21368 - protein, 495 aa, Catharanthus roseus
LLFCFILSKTTKKFGQNSQYSNHDELPPGPPQIPILGNAHQLSGGHTHHILRDLAKKYGPLMHLKIGEVSTIVASSPQIAEEIFRTHDILFADRPSNLESFKIVSYDFSDMVVSPYGNYWRQLRKISMMELLSQKSVQSFRSIREEEVLNFIKSIGSKEGTRINLSKEISLLIYGITTRAAFGEKNKNTEEFIRLLDQLTKAVAEPNIADMFPSLKFLQLISTSKYKIEKIHKQFDVIVETILKGHKEKINKPLSQENGEKKEDLVDVLLNIQRRNDFEAPLGDKNIKAIIFNIFSAGTETSSTTVDWAMCEMIKNPTVMKKAQEEVRKVFNEEGNVDETKLHQLKYLQAVIKETLRLHPPVPLLLPRECREQCKIKGYTIPSKSRVIVNAWAIGRDPNYWIEPEKFNPDRFLESKVDFKGNSFEYLPFGGGRRICPGITFALANIELPLAQLLFHFDWQSNTEKLNMKESRGVTVRREDDLYLTPVNFSSSSPA

SEQ ID NO: 21369 - protein, 495 aa, Glycine max
VMMEMDSMCMWVVLVAIAGALLVLRSMLKNVNWWLYESKLGVKQYSLPPGDMGWPFIGNMWSFLRAFKSKDPDSFISSFVSRYGRTGMYKTLMFGNPSVIVTTPETCKRVLTDDDKFTTGWPQSTIELIGKRSFISMSYEEHKRLRRLTSSSINGMESLSLYLTYIEENVKNSLEKWANMGQIEFLTEIRKLTFKIIMHIFLSSESEPVMEALEREYTALNHGVRAMCINIPGFAYHKAFKARKNLVAIFQSIVDERRNLRKGYLPGKAKDMMDALIDVEDDDGRKLSDEDIIDIMLMYLNAGHESSGHITMWATFFLQKHPEYLQKAKAEQEEIIRRRPPTQKGLTLKEVREMDFLYKVIDETLRVITFSLVVFREAKSDVNINGYTIPKGWKALVWFRSVHLDPEIYPNPKEFNPYRWNKEHKAGEFLPFGGGSRLCPGNDLAKMEIAVFLHHFLLNYRFEQHNPNCPVRYLPHTRPMDNCLGRVRKCSSTTT

SEQ ID NO: 21370 - protein, 210 aa, Triticum aestivum
  unsure (1)..(210): unsure at all Xaa locations
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVXRIIGFDNMRXVQCVSFIAFKPPGCEGVRQRAKTATHDRPYIKCHLQVLQLLTLLLGFSFLHLIS

SEQ ID NO: 21371 - protein, 480 aa, Branchioglossum woodii
QAIKNERYESGVIPYAKMGYWDPAYVIKETDVLALFRVSPQPGVDPVEASAAVAGESSTATWTVVWTDLLTACDLYRAKAYKVDAVPNSSDQFFAYIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTAATMEDMYERAEFAKQLGTVIIMIDLVIGYTAIQSMGIWARKNDMILHLHRAGNSTYSRQKVHGMNFRVICKWMRMAGVDHIHAGTVVGKLEGDPVMIKGFYDTLLLPYLDINLPQGIFFKQDWAALRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVATPTANV

SEQ ID NO: 21372 - protein, 391 aa, Ferroplasma acidarmanus
MYLIFWKLHIEKNYMLVSMVNLMYIEFTDSGMVVPDILTIGYIDGDGIGPEITGAMIGVVNSAIELAYQGSRSIEWHKILIGTEAYEKFGTYVPEDSIKEIQKMYIAMKSTLNFMPDKRDLNTILRKRLGLYSNIRILKYIEGMDIPVNTFNRLNLTIIRDSTPNSHIFYHSSESTDDLIRFISDNYGLNITPDSGIYMMPQSKFRTRKIAKQAVRYSRRNGKKKITILESQQNHEFANWCIEEASAQEDVGYEVLKTREFMKRLISSPEDFEVILVDNVLSQTLVDYLAGTINIEYGSSIGDECAVFEAVQSSLPSEAGYDAADPLSFILSGCEMLMHIGWVEAAQIIENAISAAFRDNKIPKDINTRPDISPIKCSEFSSEIIKRMNGV

SEQ ID NO: 21373 - protein, 488 aa, Petalonia fascia
MPEDVQNRTRIKSERYEPGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRKAAATCGPLKAALDLWKDITFDYTSTDTPDFVEVATGSR

SEQ ID NO: 21374 - protein, 388 aa, Desulfovibrio vulgaris subsp. vulgaris (strain Hildenborough)
MAAFKLADRLATLPPYLFAGIDKVKAEVAARGVDIISLGIGDPDMATPGFIIEAMKEAIARPANHQYPSYVGMLAFRQEVANWYDRRFGVSLDPATEVIGLIGSKEGIAHFPFAFINPGDLVLVCTPNYPVYHIATGFAGGEVQFVPLLEENDFLPDLDAIPEDTWKRAKMIFVNYPNNPTAATAPLGFYEKLVDICRRFDVIIAHDTAYTEIYYDEDNRPPSILSVPGAKDVAIEFHSLSKTYNMTGWRVGMAVGNPTLVAGLGKIKENMDSGIFQAVQEASIVALRDGDDFCRELRGIYRQRRDTVINALHKAGIQCRVPQATFYVWARVPQGHTSADFVTRVLQETGVVVTPGNGFGTPGEGFFRISLTVDNARLEEAVSRIAKL

SEQ ID NO: 21375 - protein, 356 aa, Saussurea medusa
MVAVSGNTRVESLATSGIHQIPKEYIRPQHELQTITNIFDEQNDQNAPQLPTIDLNDIHSHDPMTRQRCRDELTKAATEWGVMHLVNHGISGELIDRVKAAGESFFNQPVEEKERYCNDIGSGKIQGYGSKLANNACGQLEWEDYFFSSRLPRGERDLNVWPTTPDDYIPATTEYAKQLRALATKILSVLSLGLGLEEGRLEKEVGGMEELLLQLKINYYPKCPQPELALGVEAHTDVSALTFILHNMVPGLRLFYGGQWVTAKCVPDSIIVHIGDTIEILSNGKYKSILHRGLVNKEKVRISWAVFCEPPKEKIVLKPLPETVFEKEPPLFPPRTFHQHMEHKLFRKNNDIVDPK

SEQ ID NO: 21376 - protein, 71 aa, Zea mays
QIEWSKIQTPTDEVVVPYDTDASPPKDLEETKKLLDKLGEDKLSGGVGTTMGCTGPKGGVEDFFFCTGPGP

SEQ ID NO: 21377 - protein, 235 aa, Brassica rapa
SCERAPAAFFCKADAASLCTACDSQIHSANPLARRHQRVPILPISGSMVTNRSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESTLSETTVSHPRSPKAAMEELPEAPVQMLSPMERKARVMRYREKKKTRKFEKTIRYAS

SEQ ID NO: 21378 - protein, 311 aa, Nostoc sp. PCC 7120
MKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKFEFNKKAQSAGK

SEQ ID NO: 21379 - protein, 168 aa, Avena clauda
VMASSATSVAPFQGLKSTAGLPVSRRSASSLGSVSNGGRIRCMQVWPTEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 21380 - protein, 509 aa, Oryza sativa (japonica cultivar-group)
MFVEGFRVESPRVRYGDGEIESEYRYDTTEVVAPPSPEKGWVVRPKSVTYHFKTTTTVPKLGVMLVGWGGNNGTTLTAGVIANREGISWATKEKVHKANYFGSLTQSSTIRVGSYNGEEIYAPFKSLVPMVNPNDIVFGGWDISSMNLADAMTRARVLDIDLQKQLRHHMESMVPLPGVYNPDFIAANQGSRANNVIKGTKKEQVEQVKKDIREFKEKSKVDKVVVLWTANTERYSNVVAGMNDTMDNLLASLDKDEPEMSPSTLYAIACVMEGVPFINGSPQNTFVPGLIELAIKKNSVIGGDDFKSGQTKMKSVLVDFLVGAGIKPTSIASYNHLGNNDGMNLSAPQTFRSKEISKSGVVDDMVSSNAILYEPGEHPDHVIVIKYIPYVGDSKRAMDEYTSEIFMGGKNTIVLHNTCEDSLLAAPIILDLVLLAELSTRIQLKAEDQDKYHSFHPVATILSYLSKAPLVPPGTPVVNALAKQRAMLENILRACVGLAPENNMMLEYK

SEQ ID NO: 21381 - protein, 488 aa, Myelophycus simplex
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATIEQMYERAEYAHSIGSVIVMIDLVIGYTAIQSMAIWARKAEMILHLHRAGNSTYARQKNHGINFRVICKWMRMCGVDHIHAGTVVGKLEGDPLMVKGFYNSLLLTHLKVNLAEGLFFDMDWAALRKCVPVASGGIHCGQMHQLLYYLGDDVVLQFGGGTIGHPDGIQSGATANRVALESMVLARNEGRDYVGEGPEILRKAASSCGPLKAALDLWKDITFDYTSTDTPDFVEVATGSR

SEQ ID NO: 21382 - protein, 517 aa, Schizosaccharomyces pombe
MLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 21383 - protein, 147 aa, Pectobacterium carotovorum subsp. carotovorum
GMDRSDLFNVNAGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAGTEVVEAKAGGGSATLSMGQV

SEQ ID NO: 21384 - protein, 318 aa, Glycine max
MVSRHLVSLFLCFLCFEISVSSIRLPGLDQDAKATHGSVLRLNRGGSSVKFDPTRVTQLSWSPRAFLYKGFLSDEECDHLITLAKDKLEKSMVADNESGKSIMSEVRTSSGMFLNKAQDEIVAGIEARIAAWTFLPIENGESMQILHYENGQKYEPHFDYFHDKANQVMGGHRIATVLMYLSDVEKGGETIFPNAEAKLLQPKDESWSECAHKGYAVKPQKGDALLFFSLHLDASTDNKSLHGSCPVIEGEKWSATKWIHVSDFQKPIKQVDSGDCVDENENCPRWAKVGECEKNPLYMVGGEGVKGSCMKSCNVCSS

SEQ ID NO: 21385 - protein, 519 aa, Lactobacillus plantarum WCFS1
MKIKAQIGMVLNLDKCIGCHTCSVTCKNTWTNRPGAEYMWFNNVETKPGVGYPKRWEDEDHYKGGWELNSKGKLQLRAGNKVNKIALGKIFYQPDMPELDDYYEPWTYDYQTLFGPEKAHQPVARATSQITGLKMDLKTGPNWDDDLAGSPEYFKADPNMEKIETDIKANFEQAFMMYLPRLCEHCLNAPCVASCPSGAMYKRDEDGIVLVDQERCRGWRFCMTGCPYKKVYFNWKTHKAEKCTFCYPRIEEGEPTVCAETCVGRIRYIGAMLYDADRVEEAAETPEEDQLYQAQLDLFLDPNDPDIIEQALADGISEEMLEAAQNSPIYRMAVEEKIAFPLHPEYRTMPMVWYIPPLSPVMNYFEGRDSIKDPEMIFPGIDEMRIPVDYLASLLTGGNVPAIKGALYKLAMMRLYMRAKTGGKDFDAAKLQRVGLTENTATSLYRLLAIAKYEDRFVIPQNHKEQVEDAQSEQGGLGYDECAGCALAPQHGSMFKKAEAGESTNQIYAESFYGGIWRD

SEQ ID NO: 21386 - protein, 136 aa, Nicotiana tabacum
GGHGIVGAQVPLGVGLAFAQKYSKEEHVTFAMYGDGAANQGQLFEALNMAALWDLPAILVCENNHYGMGTAEWRAAKSPAYYKRGDYVPGLKVDGMDALAVKQACKFAKEHALKNGPIILEMDTYRYHGHSMSDPA

SEQ ID NO: 21387 - protein, 390 aa, Clostridium thermocellum ATCC 27405
MDYRKESLRLHGEWKGKIEVIHKVPVSTKEELSLAYTPGVAEPCLAIQKDVNLSYEYTRRWNLVAVITDGTAVLGLGDIGPEAGMPVMEGKCVLFKKFGDVDAFPLCIKSKDVDEIVKTIKLISGSFGGINLEDISAPRCFEIERRLKEECDIPIFHDDQHGTAVVTVAAMINALKLVNKKIEDIEVVVNGSGAAGIAVTRLLMSMGLKKVILCDTKGAIYDGRDNLNSEKALIAKISNLEKKKGTLEDVIKGADVFIGLSVPGTVTKDMVKSMAKDPIIFAMANPTPEIMPDEAKEAGAKVVGTGRSDFPNQINNVLAFPGIFRGALDVRARDINDEMKIAAAKAIASLVSDEELNPDFILPLPFDPRVGKTVAAAVAEAARKTGVARI

SEQ ID NO: 21388 - protein, 318 aa, Heliobacterium chlorum
NGFGRIGRQSFKAMLEYYPEEFEIVAINDLTDAQTLAHLLRYDSTYGAFDGEVTVTEKAIVVEQDDIRYELLTLAERDPAALPWKELGVDIVIESTGRFTDAEKAKAHLAAGAKKVIITAPAKGEDITICLGVNDAKYDHEKHHIISNASCTTNCLAPVAKVLNDRFGIERGLMTTIHSYTMDQNLQDNVHKDLRRARAAAINMVPTTTGAAKAVALVIPELKGKFHGYAVRVPTPTVSMVDFSVLLSTKTSVEEINQAFIEASESEELEGILGVSHDPLVSTDFIGTTYSSVVDLPLTMSMGDDFFKIVAWYDNEWG

SEQ ID NO: 21389 - protein, 270 aa, Zea mays
AANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 21390 - protein, 329 aa, Thermoanaerobacter tengcongensis
MNIPKETLMRMYLEMVTIRLYEETMAEAYQEGKYPVFNIASGPVPGEMHLAAGQEPVAVGVCMHLKKEDAVVGTHRPHHFAIAKGVDLKRMTAEIFGKVTGLGRGKGGHMHLFDPDVHFSCSGIVGASIPQAVGAALAFKMRKEKRVAVAFFGDGAANQGTFHEGLNLAAIWKLPVVFVCEDNSWAISVPKEKSTAISQNADRAVAYGIPGVYVGENDVLAVYEAAGEAIERARQGGGPTIIEVKTDRFFGHFQGDPEVYRPKDEVQRLKQNDPIKRFRKYLIENDIATEDELKQLDDEARKRVEEAFLFARESPYPAPEEALLHVFVE

SEQ ID NO: 21391 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 21392 - protein, 150 aa, Glycine max
TKEDILSLPCFQNQEIIAIKAPKASCIEVPDPDEELGFRQRQYKMIVRSAIGPINLYLLSKDDSKFEDDSAKRMKLMDPSWNSDPIRKRGVGLLESQHDEKNPSEHFSLQGSQAFGIQEITPTDFEMEDDYWFQSDPGVSQTELWGSNIF

SEQ ID NO: 21393 - protein, 128 aa, Glycine max
AQRLHRPNSPHLSIYQPQVTWYPSGFNRITGVGLSGVLYAASLVYLFHPLYPALDSAHLISLVHSLPTWVKGGIKFVFAVPFTFHTFNGIRHLAWDTGFGLTIKGVYTGVYIVMAATAVSSIWLAFFV

SEQ ID NO: 21394 - protein, 474 aa, Lactobacillus plantarum WCFS1
MDLSHTRLLRKKDINAMLATYHSPLKKELKTFDLTMLGIGAIIGTGIFVLTGTGALTAGPGLMISFVLAAIACLFASLCYAEFAAMVPESGSAYTYAYTTLGEIVAFIIGWDLMLEYLFAVSTVSAGWSGYFQSFLAGFGLKLPAALSAAAGSVPGVTSYFNLPAFTIIILITTLLSLGVKETKRVNNVMVVIKLAVVLLFIFTAVRFIKPANWSPLLPFGFKGVFGAASSVFFAFIGFDAISSSVEETLEPSKTLPRSMLLSLGICTILYVAVSAIMTGVVPFETFAKYIDHPISAVLIYSGQNWMAGIIDLGAILGMTTVMLVCLYGQTRISFSMSRDGLLPHVFSDISAKTGAPLKSTVLFGSIAAIMGGFIPLADLAELVNIGTLTAFTLVSFSILRLRKTQPDLRRPFKTPWVPFVPIMSIICCVFLLINLKPVTWIRFVVWLAIGMVVYFGYSVKHSQLKTDTATDEK

SEQ ID NO: 21395 - protein, 391 aa, Zea mays
  unsure (1)..(391): unsure at all Xaa locations
MAHQDAGVGGKDHRELQAQHTTDTEELLAAHRELWSHALGYVKSMALKCALDLGIPDTIQRYGGGATVGELAAASNLPASSLPFLRRLMRTLTAMRIFAVHRDDDPSDDPADDAAAVVSYQLTATSRLLVNGGSYFSIRPNISALVHQGAVSPMFSMSEWMKQHHHHAPDMTLHEMVHGEPVWESFRANPAIRAWFYDAMDADARLVMHVVLSECPAVFHGLASLVDVGGGHGTAAAAIARAFPHIXECTVMDLPHVVAEAPAGTAGLSFHGGDMFEHIPSADALMLKWXLHDWDEDKCIKIMERCKEAIGGKEAGGKVIIIDTVLGSRADDDDDDKTCRETYVLDLHILSFVNGAEREEHEWRRIFLAAGFRDYKITHTRGIPSIIEVFP

SEQ ID NO: 21396 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 21397 - protein, 359 aa, Haemophilus somnus 2336
MAKLLDIVKPGVLTGDDVQKVFAYAKANNFAIPAVNCVGTDSVNAVLETAARVKAPVIIQFSNGGAAFYAGKGIKPASGIRPDVLGAIAAAKHVHTLAAEYGVPVILHTDHAAKKLLPWIDGLLEAGEKHFCETGKPLFSSHMIDLSEEPMAENMAICREYLARMDKMGMTLEIEIGITGGEEDGVDNSDVDESKLYTQPEDVLFVYDQLSPISPRFTIAAAFGNVHGVYKPGNVKLKPSILGASQEFVSKERNLPAKSLDFVFHGGSGSSTEEIREAISYGAIKMNIDTDTQWATWEGVLNFYKANEAYLQGQLGNPEGPDAPNKKYYDPRVWLRKAEESMSKRLEKSFEDLNCVDVL

SEQ ID NO: 21398 - protein, 184 aa, Triticum aestivum
MPVSSSPPRAVSTPTAEQFRSDGVVTRGQAYGIRSIRVDGNDTLAVYSAVHTAREMAITEGRPILIEAMTYRVGHHSTSDDSTKYRPADEMEHWRTARDPVSRYRKWVQGNGWWCDTQESELRNNVRQELLQAIQVAERMPKHGLAELFTDVYDQMPSNLREQERSLLDTIKKHPAEYPADVPA

SEQ ID NO: 21399 - protein, 141 aa, Triticum aestivum
  unsure (1)..(141): unsure at all Xaa locations
MAPTVMASSATSVAPFQGLKSTAGLPVSRRSNGASLGSVSNGGRIRCMQVWPIEGIKKFETLSYLPPLKHXGLLKXVDYLXSAPKWVPCLEFKQGGXTSREHNASPGVYDGRYWAMWKLPMFRCTDPTRXXQVEEARGYLT

SEQ ID NO: 21400 - protein, 299 aa, Escherichia coli K12
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIMLGAFTFGERLHGKQLAGIALAIFGVLVLIEDSLNGQHVAMLGFMLTLAAAFSWACGNIFNKKIMSHSTRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 21401 - protein, 127 aa, Vitis vinifera
VAGDMFTSVPKGDAIFMKNILHSWSDEHCVKLLRNCYHALPDNGKVIVVDAVIPDAPEPSAQVKSTYQLDLFMMNLNPDGKERTEKEFAELAKEAGFFSTKVAGCAYSFSLVEFHNKMQHDLIMIVI

SEQ ID NO: 21402 - protein, 376 aa, Hordeum vulgare
MDKISAPFFSGTSPAAASVAGVDEDDRLCFQAQELMFAYNISMVLRAAIQLGLLDALSAAGGKALTPNELVENVETSSNKAEAAAAVDRILRYLSCFNVVTCSSEAAGPDGTLVRRYTTGPLCRWLTKDRGDGTLSPFAVFVVDPDHLFPWHHIAEAVTAGGPSAFERTQKWPYYEYMGKNQRLGTLFDNAMAQHSVILVTKMLERFKGFDGVQRLVDVGGGTGSTLGMITSKYKHMTGINYDLPHVIAQGLPLPGVEHVAGDMYESIPTGDAVLLQWITLMLNDDEFVKILSNCHNALPKDGKVIVVDGILPENPDSSLTARDAFTLDIIMFVLFKGAKQRTEKEFARLAKQAGFTGGIKKTYIFFNFYALEFTK

SEQ ID NO: 21403 - protein, 196 aa, Oryza sativa (japonica cultivar-group)
MDLAAVHAALAGKSYSSVAPLCDDLFLQAASRGAATDGWPYAVHLLAHLYLNDLNSARFLWKSTPQEAKDARPELAAVWRIGQCLWNRDYAGVYAAAQGFEWSPEIADFVAAFLESYRKRIFQLLTSAYSTISVADVAHFMGMNEEDATNYAMQNGWSLDAAARMLTVVKPKVKTNQKLDASKLQRLTECVFHLEH

SEQ ID NO: 21404 - protein, 289 aa, Amanita muscaria
LETDLDVVAINDPFIDLAYMVYMFKYDSVHGRFSGSVETKDGKLWINQKPITVFRKRDPVQIPWGSAGAEYIVESTGVFTTTEKASAHLKGGAKKIVISAPSADAPMFVCGVNLDKYDPKFQVVSNASCTTNCLAPLAKVVNDKFGIVEGLMTTVHATTATQKTVDGPSAKDWRGGRSVNNNIIPSSTGAAKAVGKVIPELNGKLTGLSFRVPTLDVSVVDLVVRIEQSATYDEIKEAFREASKGSLKGIIEYTDEHVVSTDFIGHTASSIFDSLAGIQLNANFVKLIA

SEQ ID NO: 21405 - protein, 346 aa, Magnetospirillum magnetotacticum
MRFADLNPETETVLPVSGRLAAGAEAGTAQLSGAIRIFTGAPMPPGADTVFMQEDVRRDGDRVTLPPGLKRGANARPAGEDLGKGALAIPVGRRLRPQDLALAAATGHGHIAVRRRLRVALFSTGDELTEPGAPLRPGAIHDSNRVLLAILLTRLGVTVSDLGILRDDPTTLPGHLAEAARDHDLILTTGGVSTGEEDHVKAAVEAQGRLMLWRLAIKPGRPVAAGLVAGTPFLGLPGNPVAVYVTLLFVVRPLLARLGGAIYEPPLSWPVRAGFAYRKKAGRREFVRVSLARGADGTIEARKFPRDGAGVLTSLTESDGLVELPDDAVGIASGDTLAYYPHALLW

SEQ ID NO: 21406 - protein, 337 aa, Oryza sativa
MAATPGSSRPANVAAAAATEARFHSHPPQQDRRSGWAGCLSGLPCSGSQKGGKRIVPAARVPDGNASTSRGNAHQSGANSNQSAALNLSLLAPPSFSGSFSNSAIPSTAQSPNCFLSISANSPGGPTSNMFAVGPYANEPQLVSPPVFSTYTTEPSTAPLTPPPELAHATTPSSPDVPYARFLLSSMDLKTAGKDHSSGLQASYPLYPESPSSSLISPASATPRTGLSSPSDTPYSRNSPSNIFGLDSAASRNYMLDNNFFRPAASAQFYLDQAQQSFPYNNGGRISVSKDKQDVEEVEAYRASFGFSADEIVTTQTYVEIPDALDEGFSISPFGNN

SEQ ID NO: 21407 - protein, 139 aa, Triticum aestivum
  unsure (1)..(139): unsure at all Xaa locations
TLALNSXXXMXREHQNVLDAFQLLKEDASVQKMVMALSTDKAVWNAVMNNEVVQEFKKSFQDAKETDNKGSSSAPPGMMQWVLENTQAKIKEFLEKILQLVHTLFQAQSMDYDLSDDVVRMSFMLSVFVFIVVTIARIK

SEQ ID NO: 21408 - protein, 379 aa, Streptococcus agalactiae NEM316
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMDYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVVGVPNED

SEQ ID NO: 21409 - protein, 160 aa, Triticum aestivum
MAVDTTTAAPSHPEGDEGGEEAVRPLLSGAPAEVEDEELDIRYAPYARRDAYGPMGRGPLSAAQVARLVLAGVVLLPLRLVAGVLLVVAYYLVCRVCTLFVGGVGEGRPRLQGLRREAVLRAGRVLSRAMLFVFGFYWIPVSDRSFPNAEVSTRPSSVTL

SEQ ID NO: 21410 - protein, 488 aa, Mikrosyphar porphyrae
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKBYGRVVYEGLTGGLDFLKDDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 21411 - protein, 294 aa, Candida albicans
MPSDPEEDYIPWIQQLCELFGHDYFVQVSQDFIEDDFNLTGLSSQVPYYREALYTILDYQVETAEDHNTDNTTTNTSNNNDSRNGTSKRNASELPNKALLAHSAELLYGLIHARYIVSKQGLTAMASKFERNDFGSCPRYFCDGMHLIPVGSTDVPGQETVRLFCPCCNDIYIPSSSRYLNIDGAFFGTTFPGLLVKMFPEIENQCRIRITKFSQNDFGLKLFGFKINELSATGPRMKWLRMHPETEGEKQELTHVNIMFQLATYMKTKRMEEDDEEEEDEVEEEDDDRTMASE

SEQ ID NO: 21412 - protein, 614 aa, 'Chlorella' ellipsoidea
ELNLDDVGYDDVGGVRKQMAQIRELVELPLRHPQLFKTIGVKPPKGILLYGPPGSGKTLIARAVANETGAFFFLINGPEIMSKLAGESESNLRKAFEEAEKNSPAIIFIDEIDSIAPKREKTQGEVERRIVSQLLTLMDGLKARSHVIVMGATNRPNSIDAALRRFGRFDREIDIGVPDEIGRLEVLRIHTKNMKLDENAELELIGRDTHGYVGADLAALCTEAALQCIREKMDVIDLEDDTIDAEILNSMAVTNDHFKTALGISNPSALRETVVEVPNVNWEDVGGLEGVKRELQEVVQYPVEHPEKFEKFGMSPSKGVLFYGPPGCGKTPLAKAIANECQANFISVKGPELLTMWFGESEANVREILDKARQSAPCVLFFDELDSIANQRGSSQGDAGGAADRVLNQMLTEMDGMNSKKTVFIIGATNRPDIIDSALLRPGRLDQLIYIPLPDDPSRNQIFKAALRKSPVAPDVDINQLVKYTNGFSGADITEICQRACKYAIRENIEKDIEREKRLADNPDSMEEDVDEVPCITRAHFEEAMKYARRSVSDADIRKYQAFAQTLQQSRGFGSDFRFPDRPGQAPATTPAGQAAAPAFASGAAADDDDDLYS

SEQ ID NO: 21413 - protein, 255 aa, Populus deltoides
MGRGRVQLKRIENNISRQVTFSKRRTGLLKKAHEISVLCDADVAVIVFSTKGKLFEYSTDSSMESILERYERCSYAEQQFVPHGPEHQGSWFLEHPKLRARVELLQRNLRNYTGQDLDPLSYKELHHLEQKIDTALKSVRSRKNQLVHESLAEMQKKEKALQDQNNILVEQVKKKLKALTEQAQWEQQNLGQNSSSFMLPQAQPPLQPSMLSHPPPTLGGSFQIRGFLNGNKDVEVQTQPSTMPHWMLRHVNDRI

SEQ ID NO: 21414 - protein, 244 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSSVEISQYLPLLLKLVVLAYAALCLGELLHRWSSGGSCSLSPWCA

SEQ ID NO: 21415 - protein, 107 aa, Oryza sativa
  unsure (1)..(107): unsure at all Xaa locations
MAPHAEVGTGSSNGSVYNGRGSSATQDLFTVNSPNVTYTDAEIRSRYTYRTTKVEVDASGKYVATPNETLYDFKVDRKVPKVGMMLVGLGGNNGTTVTAGILANXRQ

SEQ ID NO: 21416 - protein, 87 aa, Leersia perrieri
KARYVKFHWKPTCGVSCLMDDEATLVGGKNRSHATQDLYDSIAAGNFPEWKLFVQVIDPEEEERFDFDPLDDTKTWPEDEVPLRPVG

SEQ ID NO: 21417 - protein, 531 aa, Citrus unshiu
MDSCCVGLRANTHVVKASKYGSKIGDNALWGERIRGSVRNDGCTKQLKKSLKAEKRDEKVKPGVAYAIMTSKHPNEVMTLAPPRLERRRVDPKNVAAIILGGGAGTKLFPLTLRAATPAVPVSGCYRLIDIPINSGINKIFVLTQFNSASLNRHIARTYFGNGTNFGDGFVEVLAATQTPGESGKNWFQGTADAVTRFTWVFEDAKNRNIENVAILCGDHLSILCGDHLYRMDYMDFIQSHVDRDADITISCAAVGESRASDYGLVKIDNMGRIAQFAEKPSGANLKAMQVDTSLLGFSPQEARKSPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 21418 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKNCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEECKSIGTLSAFEQNAL

SEQ ID NO: 21419 - protein, 536 aa, Glycine max
  unsure (1)..(536): unsure at all Xaa locations
MAGELGVLNALDVAKTQWYHFTAIVIAGMGFFTDAYDLFCISLVTKLLGRLYYTEPGAPKPGSLPPRVQASVTGVALCGTLAGQLFFGWLGDKMGRKRVYGLTLILMVVCSLASGLSFGSTPEGVMASLCFFRFWLGFGIGGDYPLSATIMSEYANKKTRGAFIAAVFAMQGFGILAGGVVALIVSYAYDXRYKLSSYEQNSKASSXPAFDFVWRIGLMLGAVPAALTYYWRMKMPETARYTALVAKTAKQAAADMSKVXLQVELEAEEEKVMKLTENESNKYGLFTKEFAKRHGLHLLGTTTTWFLLDIAFYSQNLFQKDIFSAIGWIPPAKEMNAIHEVYRIARAQTLIALCSTVPGYWFTVAFIDIMGRFAIQLMGFFFMTVFMFALAIPYNHWKNHNNIGFVVMYSFTFFFSNFGPNATTFVVPAEIFPARLRSTCHGISAAAGKAGAIVGAFGFLYAAQSTNPNKVDHGYPTGIGVKNSLIVLGVINFFGMVFTLLVPESKGKSLEELSGENEDDGAEAIEMAGSARTVPV

SEQ ID NO: 21420 - protein, 233 aa, Oryza sativa (japonica cultivar-group)
MRKSSINGVHVIGVPVTAKAFGIEEEVSLARGQSFRKADGDHLAVSLSHPSPYTSFGYKHSSKGQVIHWVSKLSRRAQGFREHVTLGPKLSETVKGKLSLGAKILQAGGIERVFRKAFSAEKGERLVKALQCYLYTTGGPIAGMLFVSTKKVAFRSDRPVTVTSAKGDVARVPYKVVVPLRRIAQVRPSENADKPEEKYIHVVTVDGFEFWFMGFVSYQRSCKYMQQAISELQ

SEQ ID NO: 21421 - protein, 109 aa, Zea mays
  unsure (1)..(109): unsure at all Xaa locations
MWTYRDEDPRLHDIKTKIRVVPNFPKPGIEARGFIFGSPIALAIRAKFVPLRKPXKKLPGKVISQEYILEYGRDCLEMHVGAVEPGERALVGDDLIATGGTLCADMDLL

SEQ ID NO: 21422 - protein, 414 aa, Arabidopsis thaliana
MAEPETLSSFVQHEYANNHQVMDFPGGKVAFTPEIQFISESDKERVPCYRVLDDNGQLITNSQFVQVSEEVAVKIYSDMVTLQIMDNIFYEAQRQGRLSFYATAIGEEAINIASAAALTPQDVIFPQYREPGVLLWRGFTLQEFANQCFGNKSDYGKGRQMPVHYGSNKLNYFTVSATIATQLPNAVGAAYSLKMDKKDACAVTYFGDGGTSEGDFHAALNIAAVMEAPVLFICRNNGWAISTPTSDQFRSDGVVVKGRAYGIRSIRVDGNDALAMYSAVHTAREMAIREQRPILIEALTYRVGHHSTSDDSTRYRSAGEIEWWNKARNPLSRFRTWIESNGWWSDKTESDLRSRIKKEMLEALRVAEKTEKPNLQNMFSDVYDVPPSNLREQELLVRQTINSHPQDYPSDVPL

SEQ ID NO: 21423 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRSLVVDDLIATGGTLCAAINLLERVGAEVVECACVIELPELKGRQRLKGKPLCMLVEYR

SEQ ID NO: 21424 - protein, 91 aa, Triticum aestivum
  unsure (1)..(91): unsure at all Xaa locations
KHITIHSCTEMYRKIKSNGIKTLYLATLNIEKTGLSILINLRLIEERKLSXNITLNXPTNVLHVKQDVHSIYCANTPNSYISRTTGWDQYP

SEQ ID NO: 21425 - protein, 506 aa, Magnetospirillum magnetotacticum
MLYASPNTSGAKVQYKAKYDNFIGGKWVAPVKGEYFDVITPINGKAYTKAARSGAEDIELALDAAHAAADAWGKTPPAERANILLKIADRLEANLELLAYAETVDNGKPIRETLAADIPLSVDHFRYFAGCLRAQEGGMSDIDENTVAYHFHEPLGVVGQIIPWNFPILMAAWKLAPALGAGNCVVLKPAESTPISILILAELIADLLPPGVLNIVNGYGREAGMPLASSKRIAKIAFTGSTSTGRVIAQAAANNLIPATLELGGKSPNIFFPDVAQADDGFFDKAIEGLVLFAFNQGEVCTCPSRALIHESIYDKFMDRVLGRVAAIKQGSPLDTDTMIGAQASKEQMTKIMSYLDLGKQEGAQLLIGGERAYLGGELNDGYYIQPTLFKGHNKMRIFQEEIFGPVLAVTTFKDEAHALELANDTLYGLGAGVWSRNGNVAYRMGRAIKAGRVWTNCYHAYPAHAAFGGYKESGIGRETHKVMLDHYQQTKNLLVSYSESKLGFF

SEQ ID NO: 21426 - protein, 546 aa, Bacillus anthracis str. Ames
MAENQDKNSLEEQDVKRETLTTRQGHPVKDNQNIRTIGNRGPATLENYHFIEKISHFDREEVPERVVHARGAGAFGYFETYGKVGDEPAEKYTRAKVFSGAGKKTPLMVRFSTVAGAKDSPETARDPRGFAVKMYTEDGNWDLVGNNLKIFFIRDAMKFPDMIHAFKVDPVSNVSNPQRMFDFVSRTPEATHMITFLFSPWGIPATYRHMQGSGVNTYKWVNEKGEAVLVKYHWEPKQGIRNLTQEDANSIQAMNVSHATQDLYEAIERKDYPEWELFVQIMEDGYHPELDFDPLDDTKLWPEEQFPWLPVGRMVLDRNPVDYHSEIEQAAFGTGVLVDGMDFSDDKMLQGRTFSYSDTQRYRVGANYLQLPVNAPKAPVRTNQHRGQMDMRNPKESGENPHINYEPSMLGGYKDAKQEKHHPHQPTYNAAAMSAPIDRPNNYGQAGHTYRSFEEWERNELVKNLSEALAVCDKRIQNAMIAHFTQADEDYGRRVKEGIEKKMKEAKTENKLPGREVSKSKYGQGSLAANEATKDAVKKSHESDPY

SEQ ID NO: 21427 - protein, 181 aa, Triticum aestivum; identical to SEQ ID NO: 3887

SEQ ID NO: 21428 - protein, 337 aa, Zea mays; identical to SEQ ID NO: 2954

SEQ ID NO: 21429 - protein, 248 aa, Anthurium andraeanum
MTAKAKRGAAVAAEARVAKKRVVKLNKGPWTAEEDQKLVEYVDAHGDRKWTSLPTKAGLNRCGKSCRLRWLNYLRPGIKRGNISEAEEDMIIRLHNLIGNRWSLIAGRLPGRTDNEIKNYWNTHLSKKPLTISDLNDKLNDDGGSRSDVDEPPSSGQSQGPLDSRRPAEPRISEASNEVAFNVDELVNLPAILDFDDLLDSGSCSDGIITSSQIFWTPNFSAHDQQDISDFDDLGMLMDIMDYVICPP

SEQ ID NO: 21430 - protein, 582 aa, Ferroplasma acidarmanus
MADSISEKTVIANSKLQDKRLKKALNTWDLYFLSLGGIIGSGWLFAAAASAGTTGPAAILSWIIGGVIVLFIALVYAELGSMIPRTGAISRYGHYSHGGVAGLFFGWTYFLSAVSVPAIEAEAVITYASSYIKGLSYSAPNPINPSATVALLTGLGILLAAILIVAFFALNYAGVRIMGKTNTGMTWWKLIIPSITIVMLAFLVFHTSNFTSPALGGFLPGNNSATIFEAVSTDGIVFSFLGFRQALDYGGEAKTPQKSIPRATIFSVLTGIVVYVLLQVVFIGAIDPTKLAAAGGWFGLVSSTPTTYAASVVAAPFAFLAKSSGIFALVVLTYVLYADAYVSPAGTLNVYAGTSTRTLFGLAEIGYFPKQLSVVSKKTHVPVLPIILSVIIGIIFLAPFPSWYALVGLITGATAFTYIVGGSALMVLRREADALKRPFKLPFAKILAPIAFIGATLIVYWSGWPTIPYLAIGIFLGIVVYLIILATHKVENVFTKENIKAGWWVPGFILVLTLLSYLGEGDYGGTNTLPYPYDFVVVIIVAIIFYLISIRSGYRTEEISDIIESGTQYIQEEDVTTTAGQK

SEQ ID NO: 21431 - protein, 393 aa, Triticum aestivum
  unsure (1)..(393): unsure at all Xaa locations
MAFRACLPSHKASPSPSVAQRRASNGAPPVVAMASTMNEVKTAKKPYAPPREVHLQVMHSLPAQKQEIFDSLQSWARDNLLNLLKPVEKSWQPQDFLPDPSSEGFYDEVKELRERAKEIPDDYFVCLVGDMVTEEALPTYQTMLNTLDGVRDETGASPTAWAVWTRAWTAEENRHGDLLNKYMYLSGRVDMRQIEKTIQYLIGSGMDPGTENNPYMGFLYTSFQERATFISHGNTARHAKQFGDLKLAQICGTIAADEKRHETAYTKIVEKLFEIDPDYTVLAFADMMRKKISMPAHLMYDGEDDNLFEHFSSVAQRLGVYTAKDYADILXEFLVQRWKVADLTGLSGEGRRSQDYVCTLATRFRRLDERAQARAKQGPVVPFSWVYDRKVQL

SEQ ID NO: 21432 - protein, 520 aa, Kluyveromyces lactis
MNEYDAVDRHTFKVFNQDFTVDKRFQLIKEIGHGSYGIVCSARFTEAADETTVAIKKVTNVFSKTLLCKRSLRELKLLRHFRGHKNITCLYDMDIVFQPDGMFNGLYLYEELMECDMHQIVKSGQPLTDAHYQSFIYQILCGLKYIHSADVLHRDLKPGNLLVNADCQLKICDFGLARGYSENPVENNQFLTEYVATRWYRAPEIMLSYQGYTKAIDVWSCGCILAELLGGKPIFKGKDYVDQLNRILQVLGTPPEETLKRIGSKNVQDYIHQLGYIPKIPFSTLYPNANPDALNLLEGMLSFDPQLRITVDDALQHPYLSIWHDPADEPICTEKFDFSFESVNEIEQLKQMVIDEVTDFRQYVRLPLLHEQQQQQGKTDGGFDDQIREDQRTFQAQLEEQVNNGRTASNVPSFDEPFSSQMMGSASQQDPLVGIHSDNLPSHELDFPPRPSENVLDSPMGLSHQQTHNGSPECQDINDLLGLERELEFGLDRQFNETVWYIASSTLFVEHKLLLRFCYT

SEQ ID NO: 21433 - protein, 186 aa, Zea mays; identical to SEQ ID NO: 7881

SEQ ID NO: 21434 - protein, 525 aa, Triticum aestivum/Thinopyrum intermedium alien addition line; identical to SEQ ID NO: 14735

SEQ ID NO: 21435 - protein, 581 aa, Oryza sativa
  unsure (1)..(581): unsure at all Xaa locations
LKVLVLGVKANGYVQMLIIAVITFVNSKSSLRSAFACAAGGPAATLPFCRRSLPARARARDLVARLTRAEKVRLLVNNAAGVPRLGVAGYEWWSEALHGVSDTGPGVRFGGAFPGATAFPQVIGTAASFNATLWELIGQAVSDEGRAMYNGGQAGLTFWSPNVNIFRDPRWGRGQETPGEDPAVAARYAAAYVRGLQQQQPSSGRLKLAACCKHFTAYDLDNWSGTDRFHFNAVVTRQDLEDTFNVPFRSCVVDGRAASVMCSYNQVNGVPTCADAAFLRGTIRRRWGLAGYIVSDCDSVDVFYSDQHYTRTREDAVAATLRAGLDLDCGPFLAQYTEGAVAQGKVGDGDIDAAVTNTVTVQMRLGMFDGDPAAQPFGHLGPQHVCTAAHQELAVEAARQGIVLLKNDGRALPLSPATARRAVAVVGPHAEATVAMIGNYAGKPCRYTTPLQGVARYAARAAHQPGCTDVACAGSGQPIAAAVDAARRADATIVVAGLDQKIEAEGLDRASLLLPGRQAELISSVAKASKGPVILVLMSGGPIAIXVAQNDPKIAGILWAGYPGQAGGQAIADVIFGHHNP

SEQ ID NO: 21436 - protein, 515 aa, Escherichia coli CFT073
MEYPSHNDMSQQFNPYLCYFRPDTCVSCSRIFSLCLTLCWQEKMVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 21437 - protein, 214 aa, Physcomitrella patens
LSDIHCTQCLPIRLSLVLSSALSKFRESVAMASAVVSTVVAPVALGGASSCVGAPSESSSVKAFSGLKSATLFSGKTQKLSSVQNGSRVQCMQVWNPIGQPKFETFSYLPPLTDDQIAKQVDYMIQQNLIPCIEFDTVGSVSRTNFSGAGSSGYYDGRYWTMWKLPMFGCTDSSQVLREIQECKSQFPSCWVRVLGFDSKKQVQICGFLVSRPN

SEQ ID NO: 21438 - protein, 552 aa, Archaeoglobus fulgidus DSM 4304
MRAADAIVKALEMEGIEVVFGIPGGAIIEVYDALYDSGIRHITTRHEQGATHAADGYARASGKVGVAFATSGPGATNTVTGIATAYMDSSPLVVFTGQVPTSMIGNDAFQEADITGITMPITKHNYLVTDTKDLLGTIKEAFHIASTGRPGPVLVDLPKDITTADIDFNYPKKVSLPGYKPKLEGHPRQIAKAAELIMKAERPVILAGGGVIISNASKELVELAETIPAFVVTTLMGKGSIPETHPLSLGFAGMHGTKYANYALSESDLIIAVGCRFSDRTTGNVAMFAPEAKIIHIDIDPAEIGKNVRVDVPIVGDARKVLAKLKKAVEYKQRKEWEDKVNDWKKRYPLKYKKEGFKPQYVIERACEIMPDAIITTEVGQNQMWAAQFFKTKYPRQFITSGGLGTMGFGFPAAMGAQVAFPEKTVIDIAGDGSFFMNIQELATCVKYEIPVKVLVLNNGYLGMVRQWQELFYRERYSATCIGCEKTGFEAIARGFGAIGMTVEKPSEVDDALKEAKEVDAPVVIDFRVDYQANVFPMVPPGAALNEIIDEE

SEQ ID NO: 21439 - protein, 308 aa, Azotobacter vinelandii
MTSKLEQLKQHTTVVADTGDLDAIARLQPVDATTNPSLLLKAASLPRYAGLLEHAITGCSGDLGLACDRFAVAVGQEILGVIPGRISTEVDARLSFDSQATIGRAERLIGLYEQAGITRERVLIKIAATWEGIRAAERLEKAGIQTNLTLLFSFAQAAACADAGVFLISPFVGRIYDWYKKAEGRDFASVEDPGVQSVTRIYNYYKANGYDTVVMGASFRNLGQIEQLAGCDRLTISPELLQQLAGEQGSLERKLAPGSSGEPRQTLDEPTFRWALNEDAMATEKLAEGIRLFARDQIKLEALLSEKI

SEQ ID NO: 21440 - protein, 521 aa, Oceanobacillus iheyensis HTE831
MLPLMITLFYPPACYTPLFLYKMFIIIHIGNIYLCTQSQDKGACNDMYNNVKHFINGEWVESTGNETIDVINPATEEKMGTISAGTEEDLDKAVQAARKAFPSFSNTTREERVKLLDRIADEYEKRKDDFIKVITQELGSPVTFTEKTQYEMGLRHFRETAKILRDFEFTEQREGSFIQKDAIGVSGLITPWNFPTNQLSTKLASAIAAGSTVILKPASQTPYAAMLVAEVFEAAGVPKGVFNLVNGSGSKIGNAISSHPDIDFVSFTGSGGVGTKIMENAAQDITKVSLELGGKSPIIILDDADVKYAARNAITNIAANTGQVCTAGTRALVPASMHDEFIEAIKELLPEFPVGDPQDKNTFTGPQVSEEQWNTVQDYIQKGIDSGATLVAGGTGKPDGLETGFYSKLTVFTDVNRDDTIAQEEIFGPVLSVITYNDLDEAIEIANDTIYGLAGYVVGENPETLTKAAKGIRAGRITVNDGKADFSAPFGGFGQSGIGREWGDYGIEEFLEPKTILGLPN

SEQ ID NO: 21441 - protein, 212 aa, Oryza sativa (japonica cultivar-group)
MDEEEHEVYGQEIPEDGDMDGADVDMASGGDDAAKLQELDQMKRRLKEMEEEAAALRDMQAKVAKEMQGGDPSASTAEAKEQVDARSVYVGNVDYACTPEEVQQHFQACGTVNRVTILTDKFGQPKGFAYVEFLEQEAVQEALNLNESELHGRQIKVAPKRTNVPGMKQRPPRGYNPYHGYPYRSYGAPYFPPYGYGRVPRFRRPMRYRPYF

SEQ ID NO: 21442 - protein, 170 aa, Azospirillum brasilense
VRKMNVLSVVMQSFAICCLVSILWFFAGYSIAFTEGTPYFGSLSKFMLAGITKDSLTGVIPETIFVVFQMTFAIITPALITGAFADRMKFSSMLVFTGLWSLIVYAPITHWVWGPGGYLAGDGVLDYAGGTVVHINAGVAGLVAAIVLGKRKGHPNENFAPHNLVLSLIG

SEQ ID NO: 21443 - protein, 325 aa, Pseudomonas putida KT2440
MSNQLSTEQLLHAYEVMRTIRAFEERLHVEFATGEIPGFVHLYAGEEASAAGVMAHLRDSDCIASTHRGHGHCIAKGVDVYGMMAEIYGKKTGVCGGKGGSMHIADLEKGMLGANGIVGAGAPLVAGAALAAKLKGRDDVSVAFFGDGASNEGAVFEAMNMASIMNLPCIFVAENNGYAEATASNWSVACDHIADRAAGFGMPGVTIDGFDFFAVYEAAGAAIERARSGQGPSLIEVKLSRYYGHFEGDAQTYRAPDEVKNLRESRDCLMQFRNKTTRAGLLTAEQLDAIDARVEDLIEDAVRRAKSDPKPQPADLLTDVYVAYP

SEQ ID NO: 21444 - protein, 292 aa, Escherichia coli
MKVAVLGAAGGIGQALALLLKTQLPSGSELSLYDIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVLGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNAL

SEQ ID NO: 21445 - protein, 315 aa, Dermocarpa sp.
NGFGRIGRNFVRCWLGRENSQLELVGINDTPDPRTNAHLLRYDSMLGVLKGVDIEADANSIIVNGKTIKCVSDRNPLNLPWKDWGVDLIIEATGVFVDEAGASKHLEAGAKKVLITAPGKGGGIGTYVIGVNHKDYEHGKDSIVSNASCTTNCLAPVVKVLHENFGIIKGTMTTTHSYTGDQRILDASHRDLRRARAAAINIVPTSTGAAKAVALVLPALKGKLNGIALRVPTPNVSVVDFVAQVEKKTITEEVNEALKRAAEGELKGILGYNDLPLVSCDYRGTDESSIVDASLTLVMDGDMVKVVAWYDNEWG

SEQ ID NO: 21446 - protein, 472 aa, Hordeum vulgare
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 21447 - protein, 494 aa, Streptomyces avermitilis MA-4680
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 21448 - protein, 469 aa, Glycine max; identical to SEQ ID NO: 10891

SEQ ID NO: 21449 - protein, 295 aa, Pseudomonas putida KT2440
MQLAARRLLPEERLMSQERRYSFEFFPTKTDAGHEKLMGVARQLATYNPDFFSCTYGAGGSTRDRTLNTVLQLESEVKIPAAPHLSCVGDTKAELRALLAEYKAAGIKRIVALRGDLPSGMGMASGELRYASDLVEFIREETADHFHLEVAAYPEMHPQARNFEADLANFVHKVKAGADSAITQYFFNADSYFYFVERAQKLGVEIPVVPGIMPITNYSKLARFSDACGAEIPRWIRKQLEAYADDTASIQAFGEEVITRMCEQLLQGGAPGLHFYTLNQAEPSLAIWNNLKLPR

SEQ ID NO: 21450 - protein, 112 aa, Neurospora crassa
MSRHHPDLVMCRKQSGIAIGRLCDKCDGKCPVCDSYVRPTTLVRICDECSFGNYQNKCVVCGGEGISDAFYCFECTRLEKDRDGCPKIINLGSSRTDRCPGMGLCGKIVWGG

SEQ ID NO: 21451 - protein, 527 aa, Arabidopsis thaliana
MATLSDGLFDDMSVLGVIGYVLEQTRFIFLVPILKRLVNLCQVVSVLLFVDAAYMAIVVAIVKLLGRTPQKVLKWESFKSDDIELAPSSNHPMVLIQIPIFNEKEVCQLSIGAACKLSWPLDRMIIQVLDDSTEEESQKWESEGITIKSEVRGGFREGFKAGALTAGMKHSYVDEYKCEFVVIFDADFQPEPDFLERTVPFLVHNPEIALVQAGWKYGNADECCMTRIQEMSLNYHFAVEQKSGSSILGFFGFNGTAGVWRIKALNEAEGWKDRTIVEDMDLAVRAYLRGSKFVYVDDVKVKNELPSSFQAYRFQQHRWSCGPANLFKKIAMEIIKNQNVSLWKKVYLIYNFFFLRKIVVHIFTFVFYCVILPATVIFPEIEVPKWTTIYIPATITILNAIATPKSFYLILYWILFENVMAMHRSIGTLIGLLETSRVKEWIVTQKLGESNNLRENLIFPDHYSFPERLRWREIMVGMYLFICGYYDFVFGRTYLYVYLFLQSIAFFVVGVGYVGMPVPSTPVQTSE

SEQ ID NO: 21452 - protein, 77 aa, Zea mays
  unsure (1)..(77): unsure at all Xaa locations
SDRNAFRRNVEYACTAEEVQHHFQVXGTVNRATMLNXQVGQPKRVAHIELVRIGAFQETIHSGRIXLHGRHLKAAPQ

SEQ ID NO: 21453 - protein, 173 aa, Oryza sativa
LSLKNVLAEEVVKGLQAVSDSLVRYNAMRMLRGNESSLFLSLCQAFIEVAYPYCSACFGRCYPNGAILITERRSTFDAVSQLLTVPARSTSSRGSAIERRPSGTPLREKQSGAIERKQSEGIERKQSIDESAGTTATDNGTPANGPPPVANDDSGTSSAPAQPDGQTTAAAST

SEQ ID NO: 21454 - protein, 388 aa, Hordeum vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 21455 - protein, 429 aa, Oceanobacillus iheyensis HTE831
MPYITDVYAREVLDSRGNPTIEVEIFTESGAFGSAIVPSGASTGEYEAVELRDGDKDRYLGKGVQKAVENVNDLIAPELIGIDVTRQNIIDALMIDLDGTENKGKLGANAILGVSMAAAHAAANYLEVPLYNYLGGFNAKTLPTPMMNILNGGEHADNNVDIQEFMIMPVGAPTFKEALRTGAEIFHALKKVLTSKGYNTAVGDEGGFAPNLGSNEEALQTIVEAIEAAGYKPGEEVKLAMDVAASEIYSDGKYNLKGEGVVRSSEEMVDWYEEMISKYPIISIEDGLDENDWDGFKILTDRLGDKVQLVGDDLFVTNTNKLSKGIDQGIGNSILIKVNQIGTLTETFEAIEMAKRAGYTAVISHRSGETEDVTIADIAVATNAGQIKTGAPSRTDRVAKYNQLLRIEDELAGMGEYGGLASFYNLANK

SEQ ID NO: 21456 - protein, 196 aa, Mitthyridium sp. Wall 2449
GGAKKVVISAPSKDAPMFVMGVNEEKYTNEDIVSNASCTTNCLAPLAKVINDKFGILEGLMTSVHATTATQKTVDGPSNKDWRGGRSAGTNIIPSATGAAKAVGKVLPELNGKLTGMAFRVPTSDVSVVDLTVRLEKPASYDAIKAALKEASQGKMKGILGYTEDDVVSSDFITDSQSSIFDAKAGIALSDTFVNS

SEQ ID NO: 21457 - protein, 291 aa, Schedonorus pratensis
MARMAVSVLAILLASCAVAAAASFDKEFDITWGDGRGKILNNGQLLTLGLDKTSGSGFQSKREYLFGKIDMQLKLVAGQLPPAPSPPTTCRSMGATHDKIDFEFLGNVTGEPYTLHTNVFAKGQGKREQQFRLWFDPTKAFHTYSIVWNPQHVIFAVDGTPIRDFKNHEARGVSFPKNQPMRLYASLWNADDWATQGGRVKTDWSHAPFVASFRGFSADACVMSGGAQRCPAGTMDASGTGSSWWNQELGDMSYRRMRWVQRKFMIYNYCTDPKRVAEGLPAECKIRLRSK

SEQ ID NO: 21458 - protein, 331 aa, GIBBERELLA ZEAE PH-1
MPLPAKPLDAISQAFPPKPHFTESNVPDLTGKVTIVTGANTGVGREIAQVLYSKNATVWVAARNEKKGLDAIEGIKKQHPASKGSIKFLKLDLADLTTIGPSAKEFLAQETKLDILFNNAGVMTPPEGSKTEQGYELQLGVNCLGHFLFTKHLTPLLQSTAKSAPKNSVRVIWVSSSAADVLSPKNGFERDNLDYHQPRNLMHKYATSKAGNYYHNTEFARKYKNDGIVSVSLNPGNLASELDRTSPWYMYYPRMFTTYPSINGAYTELFAAFSEEITTENSGIWVVPWGRFMPIRPDVQKGALPESEGGTGMAEFFWNWSEEQIKPYFST

SEQ ID NO: 21459 - protein, 242 aa, Oryza sativa
  unsure (1)..(242): unsure at all Xaa locations
YCYVQDYWRVFHFMPYLHESLXHFFFLFDDVGIPTXYLPIGGLGVQISPRVRPRVRXAKARYVKFHWKPTCGVSCLMDHEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYFDDKMLQCTVFAYADTQRYRLGPNYLMLPVNAPKCAHHNNHYDGAMNFMHRDEEVYIRTISTTSVV

SEQ ID NO: 21460 - protein, 226 aa, Thalictrum dioicum
MGRGKIEIKRIENTTNRQVTFCKRRNGLLKKAYELSVLCEAEVALVVFSSRGRLYEYSNNSVKKTIERYKKASTDSPNSGSVYEANVQFYQQEASKMRNQIASLQNHNRNLLGESLSNLNIRELRQIEKKIEGGISKIRAKKNELLFSEIEYMQKREIDLQTDNKYLGAMIAANERVPPEHMNLMPANEYHIMSSAPFDSRNFLPANLLDHNNNYSHSDQTTLQLG

SEQ ID NO: 21461 - protein, 315 aa, Ralstonia metallidurans
PPACTVVLKPSEVAPLNAFVLAEVIEAAGLPPGVFNLVTGYGPVVGEVLASHPEVDMVSFTGSTRAGKRVSELAAQSVKRVALELGGKSASVILDDADLPTAVKGTIGACYLNSGQTCSAHTRMLVPRSRYEEVKAIAAKVVEGFTVGDPLADTTKLGPLISAVQKERVTGYIRRGLDEGAELVAGGPDTPAGLDRGFFVKPTVLGNVDPKATVAQEEIFGPVLSVICYDTEDEAIRIANDSIYGLGGGVWSGDESRAIRVARRIRTGQVDINGGPFNMNAPFGGFKQSGNGREGGKFGLEEFLEYKSLQLKKPA

SEQ ID NO: 21462 - protein, 361 aa, Cryptococcus neoformans var. neoformans
MSTLSNFTIPKTQTAAVVKTTGAELAIEKEHPVKQASELGPGQCLVKISHTGVCHTDLHAKSGDWPVPPSHPLIGGHEGVGIIVAIGDHTAASPVKLGDRVGIKWLADSCLSCEYCRRGYEMNCPNVKLSGYTTDGTFSEYVVSFVNHVTPIPESLDSAGAASILCAGVTTYKALKVSNTKVGDWVALPGAGGGLGHLAVQYAKAMGLKVIAIDSGAAKEKLVKSLGADAWVDFKTSKDIVADIKAATGGDGPAAAVVTAANKTGYAQAIEYLKPSGTLVAVGMPDAEMGANVFWTVFKSIRIQGSYVGNRQDAIEALDIAASGQVKVVFEEKGLDSLKGVFEDLEAGKIAGRVVLKVSDE

SEQ ID NO: 21463 - protein, 78 aa, Gossypium barbadense
RIMKKALPANAKIAKDAKETVQECVSEFISFITSEASDKCQKEKRKTINGDDLLWAMATLGFEDYIDPLKIYLTKYRE

SEQ ID NO: 21464 - protein, 523 aa, Ipomoea batatas
MAAAIGAPKLAPYTCTAERNDGSARRAARFKSLSFASSNLSGDKLGSLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLIRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTIFGLDDQRAKELPFIASMGIYVISKNVMLNLLREKFPGANDFGSEVIPGATSIGMRVQAYLFDGYWEDIGTIEAFYNANLGITKKPVPDFSLYDRSAPIYTQPRYLPPSKMLDADVTDSVIGEGCVIKNCKIHHSVVGVRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 21465 - protein, 523 aa, Perilla frutescens
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 21466 - protein, 247 aa, Prochlorococcus marinus subsp. marinus str. CCMP1375
MSSAFTSSNRPIQIIPSVLPADWANMGQCVKDLEEAGVDRIQFDVMDGNFVPNLTFGPEMISACRKYCNVPFETQLMVSQYNCETMLEAYVEASKGPNGEPGVVIAHVEANVHLHRILGKIRQLGGSPSVALNPHTPMEMVKDVLDMVDHVLVMTVNPGFGGQAYIPTMLNKIKSLREVIVENNYDIDIEVDGGIKADWTISQCCAAGANCFIAGSGMFAYPSLKEGCDALRSVAKDAQNGKLLEKS

SEQ ID NO: 21467 - protein, 187 aa, Triticum aestivum
MASPSSSLCSSLGYPRAASLGGRRRVGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMS

SEQ ID NO: 21468 - protein, 83 aa, Rhodospirillum rubrum
PERVVHARGFGAHGTFETYEDLSALTSADIFQRAGEKTPAFVRFSTVAGNLGSSDVARDVRGFAVKLYTKQGNWDIVGNNTPV

SEQ ID NO: 21469 - protein, 499 aa, Brucella suis 1330
MTDRPIMTTSAGAPIPDNQNSLTAGERGPILMQDYQLIEKLSHQNRERIPERAVHAKGWGAYGTLTITGDISRYTKAKVLQPGAQTPMLARFSTVAGELGAADAERDVRGFALKFYTQEGNWDLVGNNTPVFFVRDPLKFPDFIHTQKRHPRTHLRSATAMWDFWSLSPESLHQVTILMSDRGLPTDVRHINGYGSHTYSFWNDAGERYWVKFHFKTMQGHKHWTNAEAEQVIGRTRESTQEDLFSAIENGEFPKWKVQVQIMPELDADKTPYNPFDLTKVWPHADYPPIDIGVMELNRNPENYFTEVENAAFSPSNIVPGIGFSPDKMLQARIFSYADAHRHRLGTHYESIPVNQPKCLVHHYHRDGQMNVYGGIKTGNPDAYYEPNSFNGPVEQPSAKEPPLCISGNADRYNHRIGNDDYSQPRALFNLFDAAQKQRLFSNIAAAMKGVPGFIVERQLGHFKLIHPEYEAGVRKALKDAHGYDANTIALNEKITAAE

SEQ ID NO: 21470 - protein, 375 aa, Zea mays
MALSKEQKLTIPDQQHTTSSEQQVALDAELQLWNHTFGYVKSMALKAALDLGIPDAIHQHGGSATIPQIVTRITLHPSKTPCLRRLMRVLTLTGVFGTQEPHDDGGGCDDELVYTLTPASRLLVGPSGQNVSPLLNVMLCPILVSSFLDLRGWFQHEMPDPSPFKVTHGRDIWELAAHDAGFRRLFDAGMVADSGFIMNVVVRECGAVFQGISSLVDVGGGFGGATQAIAKAFPHLECSVLDLPNVVAGAPADTAVKYVAGDMFESVSSADAVFLKWIIHDWGDADCVKILKNCKKAIPAQGGKVIILDIVVGAGSSSCDRKNVETQCLFDLYIMTINGVERDEREWKKIIFEAGFTSYKIIPVLGTRSIIEVCP

SEQ ID NO: 21471 - protein, 473 aa, Oryza sativa
ASSSSSSSSAGRRRRPLVFSPRAVSDYQELRRPAYDPDASTSVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLPSGTVI

SEQ ID NO: 21472 - protein, 440 aa, Oryza sativa (japonica cultivar-group)
MPVNMISKLLEKAVLPALDVAPPVKIGGPRRTSVLRNPNMEKLQKGYLFPEISIKREEHLKKYPDAKVISLGIGDTTEPIPSIVTSAMAEYALALSTPEGYQGYGPEQGHKNLRKEIADKVYPDMGIKESEVFISDGAQCDIARLQTLFGPNVTIAVQDPTFPGYVDNGVIMGQTGKADDGGRYAGIEYMRCAPENAFFPDLSRVRRTDVIFFCSPNNPTGHAASREQLRQLVELARRNGSIIVFDSAYSSYISSSSSSSTPRSIYEIPGAREVAIEVSSFSKFAGFTGVRLGWAVVPDELLYSDGVPVARDFDRVVCTCFNGASGIAQAGGVACLSTEEGRGAVARVVGVYRENARVLVETFRSLGKEVHGGGDAPYVWVRFPGRRSWDVFAEILEKTHVITVPGSGFGPGGEGFIRVSAFNSRDKVLEACQRLKSFLA

SEQ ID NO: 21473 - protein, 137 aa, Salmonella enterica
ATFMPKPMFGDNGSGMHGHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 21474 - protein, 293 aa, Pisum sativum
MGSSFWTVCLILASLVSSSFCALPRKPVDVPFGRNYYPTWAFDHIKYFNGGSEIQLHLDKSTGTGFQSKGSYLFGHFSMNIKMVPGDSAGTVTAFYLSSQNAEHDEIDFEFLGNRTGQPYILQTNVFTGGQGNKEQRIFLWFDPTKEFHRYSILWNMYQIVFYVDDVPIRVFKNSKDLGVKFPFDQPMKIYNSLWNADDWATRGGLEKTDWSKAPFIAGYKSFHIDGCEASVNAKFCATQGKRWWDQVEFRDLDAAQWRRLKWVREKFTIYNYCNDRKRLPQIPPECKRDRDI

SEQ ID NO: 21475 - protein, 463 aa, Yersinia pestis CO92
MELPVKNKLKRGLTTRHIRFIALGSAIGTGLFYGSADAIRMAGPSVLLAYLIGGVVAFVIMRALGEMSVNNPQASSFSRYAQDCLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 21476 - protein, 336 aa, Staphylococcus epidermidis ATCC 12228
MSYILIVTIAIVIFSLIFDFINGFHDTANAVATAVSTRALTPRRAILLAAVMNFIGALTFTGVAGTITKDIVDPFKLQHGLVVVLAAIIAAIIWNLITWLYGIPSSSSHALIGSIAGAAIASKGSFAVLHYQGFTKIIIVLIISPIIAFCVGYMMYTIVKIVFKNSNLTRTNRNFRFFQIFTAALQSFSHGTNDAQKSMGIITLALIVGNLQDGSNVEPQVWVKVVCATAMGLGTAVGGWKIIKTVGGNIMKIRPANGAAADISSALTIFVASSLHFPLSTTHVVSSSILGVGASNRAKGVKWSTAQRMVVTWVITLPISAVLAAIIYFIIHLFLK

SEQ ID NO: 21477 - protein, 198 aa, Streptococcus pneumoniae
GIEDILVVTGKSKRSIEDHFDSNFELEYNLKEKGKTDLLKLVDEATGMRLHFIRQTHPRGLGDAVLQAKAFVGNEPFVVMLGDDLMDITDENAVPLTKQLMNDYEKTHASTIAVMPVPHEDVSSYGVIAPQGEGINGLYSVETFVEKPAPEDAPSDLAIIGRYLLTPEIFDILEKQAPGAGNEIQLTDAIDTLNKTQR

SEQ ID NO: 21478 - protein, 208 aa, Corynebacterium glutamicum
MTHVVLIDNHDSFVYNLVDAFAVAGYKCTVFRNTVPVETILAANPDLICLSPGPGYPADAGNMMALIERTLGQIPLLGICLGYQALIEYHGGKVEPCGPVHGTTDNMILTDAGVQSPVFAGLATDVEPDHPEVPGRKVPIGRYHSLGCVVAPDGIESLGTCSSEIGDVIMAARTTDGKAIGLQFHPESVLSPTGPIILSRCVEQLLAN

SEQ ID NO: 21479 - protein, 469 aa, Bradyrhizobium japonicum USDA 110
MKTAKDVLKSIKDNDVKYVDLRFTDPRGKWQHVTFDVSMIDEDIFAEGTMFDGSSIAGWKAINESDMCLMPDPVTATIDPFFAETTMVITCDVLEPTTGEPYNRDPRGIAKKAEAMVKSMGVGDTVFVGPEAEFFVFDDVRFSSSPYNTGFRLDSSELPTNTDTEYEGGNLGHRVRTKGGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGLDGIKNKIDPGPAMDKDLYDLPKEELKQIPTVCGSLREALENLDKDRAFLKAGGVFDDDFIDSYIELKMTEVERFEMTPHPVEFDMYYSG

SEQ ID NO: 21480 - protein, 335 aa, Gracilaria gracilis
MTVPQVGINGFGRIGRLVLRAAIEKDTMSVVAINDPFIDLEYMAYMFKFDSTHGRYAGSVETKDGKLIVNGKSITIYGHRDPAEIPWAEAGADYVVESTGVFTLKEKAEKHFTGGAKKVIISAPSKDAPMFVCGVNEDKYTPDLNVISNASCTTNCLAPLVKVIHEKYGIEEGLMTTVHATTATQKTVDGPSQKDWRGGRGAGANIIPSSTGAAKAVGKVLPELNGKLTGMAFRVPTSDVSVVDLTVRLATETSYDDIKATMKAAAEDSMKGILKYTEEAVVSTDFIHEEASCVFDAGAGIMLNSRFCKLVAWYDNEWGYSNRVVDLIAHVAKLQ

SEQ ID NO: 21481 - protein, 349 aa, Zea mays
MRQISSLLQGLARSLSVGRDRKGNGAGDGKTAVPVPAVLRTSGTLWGDGSDTFAAVCSRRGEKGINQDCSIVWEGFGCQEGTIFCGIFDGHGPWGHYVAKAVRDSLPPSLLCHWQEALALASLIDDGEKKLGDCQFDLWKRSYVAACAAVDDELRRSRRLDAVQSGCTALSIIKQGDLMIVANVGDSRAVLGTTSGDGAIAAVQLTVDLKPNLPQEKERIRRCNGQVYCLADEPGVHRVWQPSRESPGLAMSRAFGDYCVKDCGVISTPEVTQKRISSSDQFIILATDGVWDVLSNDEAVHIVAGTPDRAKAAKRLVECAVRAWRRKRRDIAVDDCSAICLFFHPPPPS

SEQ ID NO: 21482 - protein, 664 aa, Nicotiana tabacum
MAAAAAAPSPSFSKTLSSSSSKSSTLLPRSTFPFPHHPHKTTPPPLHLTPTHIHSQRRRFTISNVISTTQKVSETQKAETFVSRFAPDEPRKGSDVLVEALEREGVTDVFAYPGGASMEIHQALTRSSIIRNVLPRHEQGGVFAAEGYARATGFPGVCIATSGPGATNLVSGLADALLDSVPIVAITGQVPRRMIGTDAFQETPIVEVTRSITKHNYLVMDVEDIPRVVREAFFLARSGRPGPVLIDVPKDIQQQLVIPDWDQPMRLPGYMSRLPKLPNEMLLEQIVRLISESKKPVLYVGGGCSQSSEELRRFVELTGIPVASTLMGLGAFPTGDELSLSMLGMHGTVYANYAVDSSDLLLAFGVRFDDRVTGKLEAFASRAKIVHIDIDSAEIGKNKQPHVSICADIKLALQGLNSILESKEGKLKLDFSAWRQELTVQKVKYPLNFKTFGDAIPPQYAIQVLDELTNGSAIISTGVGQHQMWAAQYYKYRKPRQWLTSGGLGAMGFGLPAAIGAAVGRPDEVVVDIDGDGSFIMNVQELATIKVENLPVKIMLLNNQHLGMVVQWEDRFYKANRAHTYLGNPSNEAEIFPNMLKFAEACGVPAARVTHRDDLRAAIQKMLDTPGPYLLDVIVPHQEHVLPMIPSGGAFKDVITEGDGRSSY

SEQ ID NO: 21483 - protein, 233 aa, Arabidopsis thaliana
MVSPKIAPSMLSSDFANLAAEANRMIDLGANWLHMDIMVPTFYSLLWGHFVPNLTIGAPVIESLRKHTNAYLDCHLMVTNPMDYVAQMAKAGASGFTFHVEVAQDNWQQLVEKIKSTGMRPGVALKPGTPVEQVYPLVEGTTPVEMVLVMTVEPGFGGQKFMPDMMDKVRALRQKYPTLDIQVDGGLGPSTIDTAAAAGANCIVAGSSVFGAPEPGDVISLLRTSVEKAQPTT

SEQ ID NO: 21484 - protein, 159 aa, Capsicum frutescens
MSMIPSFFGGRRSNIFDPVSLDLWDPFEGFPISSTIANTPSSARETSAFPNARIDWKETPQAHIFKVDVPGIKREEVKVQVEEGRILQITGERSREQEEKNDQWHRMERSSGKFLRRFRLPENTKMGEIKAAMENGVLTVTVPKEEEKRSEVKAIDISG

SEQ ID NO: 21485 - protein, 394 aa, Triticum aestivum
MGSFAKLAKRCVETEAPVMVKIQELLRGATDVMSLAQGIVYWQPPEAALNKVKEIVWEPATSKYGADDGLPELREALLEKLRRENKLTKSSVMVTAGANQAFVNLVLTLCDAGDSVVMFAPYYFNSFMSFQMTGVTDILVGASNPKTLHPDIDWLEKVLKENNPIPKLVTVVNPGNPSGAFIPKPMLQRISDLCKNAGAWLVVDNTYEYFMYDKMEHYCLEDDHIVNLFSFSKAYGMMGWRVGYIAYPSEADGFHAQLLKVQDNIPICASIIGQRLALYSLEAGPEWIRERVNDLVKNRELLVEAMSPLGEGAVKGGEGAIYLWAKLPDNCSDDFEVVRWLATKHGVAVIPGSASGGPGYIRVSFGGLKEEDTRLAGERLRRGLQELVTDGMVQ

SEQ ID NO: 21486 - protein, 361 aa, Oryza sativa
  unsure (1)..(361): unsure at all Xaa locations
MAHDEAVATQKIGKTTSPPKDQPTPCPFPDWSAVQAYYGPGVLPPTYFAPAIASGHAPPPYMWGPQPIMPPPFGTPYAAMYPHGGAYPHPLMPMMANPLSMEPAKSASSKEKGSNKKLKEVDGAAVSTGSGDSKKTMTSSGDYSAEGSSDVNDQKNSGXQLKSLPGAETSAAAKMENALPPSHILGSTAILPNHSFPAQVIRPSATNVANSRALGTPISPPPGQDERELKREKRKQSNRESARRSRLRKQAETEDLATQVESLTAENTSLRSEISRLSESSEKLRLENSALMGKLKDPAASTQAETSLQKTTTASSPRVVENFLSMIDNTNKTSVRHTEHAEPKLRQLLGSGPATDVVAAS

SEQ ID NO: 21487 - protein, 252 aa, Glycine max; identical to SEQ ID NO: 2776

SEQ ID NO: 21488 - protein, 371 aa, Zea mays
MRRHMAPIKEQKHTTSAEQQVMLDAELQLWNHTFGYVKSMALKAALDLGIPEAIHQHGGTATLPQIVTRVKLHPSKTPCLRRLMRVLTLTGVFGAQEPHDDDGGCDDELVYTLTPASRLLVGSPGQNVGPFLTLMLGPIFVSSFLDLRGWFQHETPDPSPFKMTHGRDIWELAAHDAAFGRLFDAGMVADSSFIMDVVVRECGGVFEGISSLVDVAGGLGGATQTIAKAFPNLECSVLDLPNVVASAPADTAVKYVPGDMFESVPAADAVFLKWIMHDWGDADCVKILKNCKKAIPAQGGKVIILDIVVGAGSSCDRKNVETQCLFDLFIMFINGAERDERQWKKIIFEAGFTSYKIIPVLGIRSIIEVCL

SEQ ID NO: 21489 - protein, 176 aa, Fagus sylvatica
KLELHRGGGRSRTSGSPGLQEFGTRSELSKICDGILGLLETHLIPSASSAESKVFYLKMKGDYHRYLAEFKTGAERKEAAESTLLAYKSAQDIALADLPPTHPIRLGLALNFSVFYYEILNSPDRACNLAKQAFDEAISELDTLGEESYKDSTLIMQLLRDNLTLWTSDITDDAGD

SEQ ID NO: 21490 - protein, 358 aa, Staphylococcus aureus subsp. aureus Mu50
MSQAVKVERRETLKQKPNTSQLGFGKYFTDYMLSYDYDADKGWHDLKIVPYGPIEISPAAQGVHYGQSVFEGLKAYKRDGEVALFRPEENFKRLNNSLARLEMPQVDEAELLEGLKQLVDIERDWIPEGEGQSLYIRPFVFATEGALGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 21491 - protein, 129 aa, Glycine max; identical to SEQ ID NO: 10938

SEQ ID NO: 21492 - protein, 140 aa, Triticum aestivum
  unsure (1)..(140): unsure at all Xaa locations
MAPTVMASSATSVAPFQGLKSTAGLPVSRRSNGASLGSVSNGGRIRCMQVWPIEGIKXFETLSYLPPLSTEXLLKXVDYLXRSKWVPCLQFNKVGFIFPXAQPSPGYYXGXYWTIWNCLCSGXTEATQVXNKWEXVKKDT

SEQ ID NO: 21493 - protein, 297 aa, Streptomyces caeruleus
MRGILLAGGTGSRLWPVTRAISKQLIPVFDKPMIYYPLTTLMMAGVREILVITRPDDQRQFRHLLGDGSQLGLRLEYAVQERPEGIAQAFVLGAEFIGDQSVALVLGDNIFHGAGLGTRLRQYNDPAGARIFAYVVADPKAYGVVEFDEAGRAVSIEEKPARPKSRYAVPGLYFYDNRVLDVVHGLVPSRRGELEITAVNETYLKWGQLRVTTLDRGTAWLDTGTFASLVQASEYVRVVEERQGLKIGCVEEVAWRCGFIGNDQLRDLSRPLLKSGYGRYLLDLLADHEELKEVKPS

SEQ ID NO: 21494 - protein, 301 aa, Zea mays
MAGLSLEHPWAFAFGLLGNVISFMTFLAPIPTFYRIYKSKSTEGFQSVPYVVALFSAMLWIFYALIKSNETFLITINAAGCVIETIYIVMYFVYAPKKAKLFTAKIMALVNGGVFGVILLLTLLLFKGSKRVVLLGWICVGFSVSVFVAPLSIMRRVIQTKSVEYMPFSLSLSLTLSAVVWFLYGLLIKDKYVALPNVLGFIFGVVQMVLYVLYMNKTPVAAAVGKDAGKLPSAADEHVLVNIAKLNPALPERTSGMHPVTQMAAVPARSCAAEATAPAMLPNRDVVDVFVSRHSPAVHVV

SEQ ID NO: 21495 - protein, 149 aa, Triticum aestivum
  unsure (1)..(149): unsure at all Xaa locations
VNWILMILCVAVTVGFRNTKHMGNASGLAVITVMLVTTCLMPLVIMLCWDRSPWLALAFFLFFGSIEALYFSASLIKFLDGAWVPILLGLILLAVMFVWHHTTIXKYEYDMHNKVTXEWLLALGDKLGMVRLPGSARLRLTPGCRKFPW

SEQ ID NO: 21496 - protein, 317 aa, Brucella suis 1330
MSSSSDAIKAALEKGRAAGLSATGGKNADYIPFLASVPSDLFGLAVVTADGQTFKTGDADFAFAIESISKVFTLALVMEEIGPDSVREKVGADPTGLPFNSVIALELHNGKSLSPLVNAGAIATASLVPGDTADARWNNILECQCGFAGRRLKLSNEVNQSEQTTNFHNRAIAWLLYSAGTCYSDPMEAVDIYTRQCSTLVTATDLATMGATLAAGGVNPISGKRMVSAGNVAPILAEMTMEGLYTASGDWAYTVGLPGKSGVGGGIMAVVPGELAIAAFSPPLDPAGNSVKAMAAVAAVADSLGHNLYTTRGKVSS

SEQ ID NO: 21497 - protein, 294 aa, Serratia marcescens
IVFRAAQERSDIEIVAINDLLDAEYMAYMLKYDSTHGRFNGTVEVKDGHLVVNGKTIRVTAEKDPANLKWNEVGVDVVAEATGIFLTDETARKHITAGAKKVVLTGPSKDATPMFVRGANFDKYAGQDIVSNASCTTNCLAPLAKVINDNFGIVEGLMTTVHATTATQKTVDGPSHKDWRGGRGASQNIIPSSTGAAKAVGKVIPELKGKLTGMAFRVPTPNVSVVDLTVRLEKPATYEEIKKAMKDAAEGSMKGVLGYVEDDVVSTDFNGEVLTSVFDAKAGIALNDNFVKLV

SEQ ID NO: 21498 - protein, 170 aa, Zea mays; identical to SEQ ID NO: 3644

SEQ ID NO: 21499 - protein, 410 aa, Oryza sativa
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 21500 - protein, 481 aa, Chlamydophila caviae GPIC
MTEQADIGLIGLAVMGKNLVLNMIDHGFSISVYNRSPEKTREFLQEHSQNTLLQGHENLEDFVRSLKRPRKVMLMIKAGAPVDQSIESLLPYLEPGDIIIDGGNSYYKDSERRCRDLKEKGILFVGMGISGGEEGARKGPSIMPGGNSEAWPAIAPIFQGISAKVHGNPCCCWVGSGGAGHYVKTVHNGIEYGDIQLICEAYGLLRTRLGISPEGISEIFAEWNSRELESYLMRISVEVLSLKGPDGSPVIDTILDVAGQKGTGRWTAIDAIDSGVPLSLIIESVLARFLSSWKTVREQAASELPGIPIVFEKPRDPHLFIEDVFQALYASKIISYAQGFMLLKQASEEHQWNLNFGELALLWRGGCIIQSAFLDAIHKGFENEPEAPSLILQTYFKSTLQNSESGWRRTVAYAVGSGYPVPCLAAALTFYDGYRTKDSSIALAQGLRDYFGAHSYERKDRPRGEFYHTDWIGTKTTTAVK

SEQ ID NO: 21501 - protein, 500 aa, Solanum chacoense
MQLVSIFLFISFLFLLRKWKKYLNNSQTKKLPPGPWKLPFIGGMHHLAGGLPHRVLRDLAEKYGPLMHLQLGEVSAVVVTSPEMAKQVLKTHDIAFASRPKLLAMDIICYNRRDIAFSPYGDYWRQMRKICIMEVLSAKSVRSFSSIRHDEVVRLIDSIQPCFTSGELVNFTERIIWFTSSMTCRSAFGQVLKEQEVFIKLIREVISLAEGFDVADIFPSYKFLHGFGGAKQKLLNAHRKVDSIVEDVIKEHKKNLATRKSDDAIGGEDLVDALVRLMNDKSLQFPINNDNIKAVIIDLFAAGTETSSTTTVWAMAEMLKNPSVFAKAQAKVREAFRDKVTFDENDVEELKYLKLVIKETMRLHAPVPLLVPRECREETEINGYTIPVKTKVMVNVWALGRDPKYWDDAESFKPERFEQCSIDFIGNNFEYLPFGGGRRICPGISFGLANVYLPLAQLLYHFDWKLPTGMEPKDLDLTESAGITAARKGDLYLIATPHQP

SEQ ID NO: 21502 - protein, 213 aa, Triticum aestivum
LAFAQKYRKEDTVSFSLYGDGAANQGQLFEALNISALWKLPAILVCENNHYGMGTAEWRAAKSPSYYKRGDYVPGLKVDGMDVLAVKQACKFAKEHAIANGPIVLEMDTYRYHGHSMSDPGSTYRTRDEISGVRQERDPIERVRKLLLAHDLATPAELKDMEKEIRKEVDAAIAKAKESPMPDASELFTNVYVKGFGVESFGADRKELRATLP

SEQ ID NO: 21503 - protein, 194 aa, Zea mays
ILRTNAHRSSGLSNFFVSSNAGVALYIFLIILPFLVLCPLRYYHQKHPVNLLLLGLFTVAISFAVGMTCAFTSGKIILEAAILTAVVVISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 21504 - protein, 335 aa, Triticum aestivum
CLLLQINPTKGNKSWSSTAVAAALELVDPPGCRNSAPGGRLPPGDMGWPLVGGMWAFLRAFKSGRPDSFIDSFARWFGRAGLYRAFMFSSPTIMVTTPDACKQVLMDDDTFVTGWPKATIALIGPKSFISMGYDEHRRLRKLTAAPINGFDALTFYLAFIDHTVVTTLRGWSERGDDFESPAELRRMTFRIIVQIFMGGADERTAAELESTYTELNYGMRAMAIDLPGFAYHKAIRARRRPGAALQCVLDERRARGAKTAGVDMMDRLIAAEDEGGRRLQDDEIIDVLVMYLNAGHESSGHITMWATVFLQENPEILAKAKAEQEAIMRSIPSGQ

SEQ ID NO: 21505 - protein, 380 aa, Schizosaccharomyces pombe
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKAVKLCCSEESVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 21506 - protein, 171 aa, Pinus thunbergii
MATGAGAGAATVVSAFTGLKSTAQFPSSFKMSNAAAEWEQKTTSNGGRVRCMQVWPPFGNPKFETLSYLPTLTEEQLVKEVEYLLRNKWVPCLEFDLEGSISRKYNRSPGYYDGRYWVMWKLPMFGCTEASQVINEVRECAKAYPKAFIRVIGFDNVRQVQCISFIVHKPE

SEQ ID NO: 21507 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLV

SEQ ID NO: 21508 - protein, 646 aa, Oryza sativa (japonica cultivar-group); identical to SEQ ID NO: 19133

SEQ ID NO: 21509 - protein, 655 aa, Brassica napus
MAAATSSSPISLTAKPSSKSPLPISRFSLPFSLTPQKDSSRLHRPLAISAVLNSPVNVAPPSPEKTDKNKTFVSRYAPDEPRKGADILVEALERQGVETVFAYPGGASMEIHQALTRSSTIRNVLPRHEQGGVFAAEGYARSSGKPGICIATSGPGATNLVSGLADAMLDSVPLVAITGQVPRRMIGTDAFQETPIVEVTRSITKHNYLVMDVDDIPRIVQEAFFLATSGRPGPVLVDVPKDIQQQLAIPNWDQPMRLPGYMSRLPQPPEVSQLGQIVRLISESKRPVLYVGGGSLNSSEELGRFVELTGIPVASTLMGLGSYPCNDELSLQMLGMHGTVYANYAVEHSDLLLAFGVRFDDRVTGKLEAFASRAKIVHIDIDSAEIGKNKTPHVSVCGDVKLALQGMNKVLENRAEELKLDFGVWRSELSEQKQKFPLSFKTFGEAIPPQYAIQILDELTEGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQWEDRFYKANRAHTYLGDPARENEIFPNMLQFAGACGIPAARVTKKEELREAIQTMLDTPGPYLLDVICPHQEHVLPMIPSGGTFKDVITEGDGRTKY

SEQ ID NO: 21510 - protein, 318 aa, Zea mays
  unsure (1)..(318): unsure at all Xaa locations
RVDPRVRPRVRGRVGHSEWRAAKKANGMKVVSLIREKTGYIVSPDAMFDVQVKRIHEYKRQLLNILGIVYRYKKMKEMSTEERAKSFVPRVCIFGGKAFATYIQAKRIVKFITDVEASGNQXHEVCIPAVLICCDNSLAGISASATXHYISTAGMEASGTSNMKFAMNGCILIGTLDGANVEIREEVGEENFFLFGAEAHEIAGLRKERAEGKFVPDPRFEEVKEFVRSGVFGTYSYDELMGSLEGNEGYGRADYFLVGKDFPSYIECQEKVDEAYRDQKLWTRMSILNTAGSSKFSSDRTIHEYAKDIWDISPAILP

SEQ ID NO: 21511 - protein, 639 aa, Agrobacterium tumefaciens str. C58
MSQIADKDVAEKPDADDSHKNKGLYAAILGSIGVVYGDIGTSPLYAFREALKPIAYDGVTREEVIGLTSLMIWSLTIIVTFKYITLLLRADNDGEGGTLSLLALLMKTAGTHRSVLIVLGLIGAALFLGDAMITPALSVLSAVEGLKLVTPAMDDFIIPISVCILIGLFAIQSHGTGTVAKFFGPITAVWFLVMGGAGLIHIADDFGILFAFNPWHAVEFLANEGFYGVVVLGAVFLTITGAEALYADLGHFGRRPIQWAWFCLVFPALTLNYLGQGALVLKDPAAMSNPFYLMFPQWAILPAVILATAATIIASQAVITGAFSLVRQAIHLGYLPRMEILFTSETNTGQIYLPAVNTILLFGVVALVLTFKSSDALATAYGISVTGAMVVTSLMFFEFVRKRWQWSIWLALAVLTPLLLLELIFLGANLLKIHDGGYVPVLLAIAFTVIMTTWQRGSRILFAKTRRGDVPLKAFVASVEKESAHAPVRVPGTAIFLTGDPEAAPAALLHNLKHNHVLHDKNVILTIRTEDQPRVRPEDRYTLTKLSDRFAVVELHFGFMETQNVTQALGYLRRTGYKFDIMSTSFYLGRRKLVPDPKSGMPGWQNRLFIALAETAADPSDYFRLPANRVVELGSHVVV

SEQ ID NO: 21512 - protein, 212 aa, Oryza sativa (indica cultivar-group)
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 21513 - protein, 356 aa, Escherichia coli K12
MSTVTITDLARENVRNLTPYQSARRLGGNGDVWLNANEYPTAVEFQLTQQTLNRYPECQPKAVIENYAQYAGVKPEQVLVSRGADEGIELLIRAFCEPGKDAILYCPPTYGMYSVSAETIGVECRTVPTLDNWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIVAMRERVAQIIAEREYLIAALKEIPCVEQVFDSETNYILARFKASSAVFKSLWDQGIILRDQNKQPSLSGCLRITVGTREESQRVIDALRAEQV

SEQ ID NO: 21514 - protein, 221 aa, Glycine max
MACSVHLLLLLLTSLLALFFNPTCVYGNDELRALLDLKSSLDPEGHFLSSWTMGGNPCDGSFEGVACNEKGQVANVSLQGKGLSGKLSPAIAGLKHLTGLYLHYNSLYGEIPREVANLTELSDLYLNVNHLSGEIPPEIGKMENLQVLQLCYNQLTGSIPTQLGDLKKLSVLALQSNLLGGAIPASLGDLGMLMRLDLSSNNLFGSIPIKLADLPSLQVLD

SEQ ID NO: 21515 - protein, 336 aa, Oryza sativa; identical to SEQ ID NO: 19592

SEQ ID NO: 21516 - protein, 103 aa, Oryza sativa
  unsure (1)..(103): unsure at all Xaa locations
MAPSVMASSATTVAPFQGLKSTVGMPVARRSGNCSFSNVSNGGRIRCMHALPIQGLHKLTTVSYLPPLTVEDLLKQIXEYLLRSKWVPCLXFNKVGFVYRENH

SEQ ID NO: 21517 - protein, 202 aa, Glycine max
MGLSILRSTSISTPISSSKSKPIFSTLVRSSFASISPTKCVTPTTLFVSATPFFTASPKRGFRGGIVAMAAAGSLRKSEEEWRAVLSPEQFRILRQKGTEFPGTGEYDEFFDEGVYNCAGCGTPLYRSLTKFNSGCGWPAFYEGIPGAINRNPDPDGMRTEITCAACGGHLGHVFKGEGFPTPTNERHRVNSISLKFAPANS

SEQ ID NO: 21518 - protein, 225 aa, Danthonia spicata
IENKISRQVTFAKRRNGLLKKAYELSLLCDAEVALIIFSGRGRLFEFSSSSCMYKTLERYRTCNFNSQEAKAPLDSEINYQEYLKLKTRVEFLQTTQRNILGEDLGPLSSKELEQLENQIEISLKHIRTRKNQALLDQLFDLKSKEQELQDLNKDLRKKLQETSGENAVHISWEEGGHSGASGNAMEPSQGFLQHPENDSDLHMGYHQQAYMDHLNNEDMAAPHH

SEQ ID NO: 21519 - protein, 279 aa, Arabidopsis thaliana
MASKSKQHLRYQPRKSVSRSTQAFTVLILLLVVILILLGLGILSLPNANRNSSKTNDLTNIVRKSETSSGDEEGNGERWVEVISWEPRAVVYHNFLTNEECEHLISLAKPSMVKSTVVDEKTGGSKDSRVRTSSGTFLRRGHDEVVEVIEKRISDFTFIPVENGEGLQVLHYQVGQKYEPHYDYFLDEFNTKNGGQRIATVLMYLSDVDDGGETVFPAARGNISAVPWWNELSKCGKEGLSVLPKKRDALLFWNMRPDASLDPSSLHGNKTKEVAFFRS

SEQ ID NO: 21520 - protein, 772 aa, Burkholderia fungorum
MTKQSGTTSFREAALDYHEFPTPGKIAIAPTKQMINQRDLALAYSPGVAFACEEIVGNPLNAARFTARSNLVGVVTNGTAVLGLGNIGPLASKPVMEGKAVLFKKFAGIDVFDIELNESDPHKLVDVIAALEPTFGGINLEDIKAPDCFIVERECRKRMKIPVFHDDQHGTAIVVAAAITNGLKVVGKDIREVKLVSSGAGAAALACLDLLVDIGLPLENITVTDLAGVVYKGRVELMDPDKERFARETDARTLAEAIGGADVFLGLSAGGVLKQDMVKQMADKPLILALANPTPEILPELALEVRPDAVLCTGRTDYPNQVNNVLVFPFLFRGALDAGATTVTREMEIAAVNAIAELARQEQSDIVATAYGIQDLSFGPEYLIPKPFDPRLIVKVAPAVAQAAMDSGVAERPIEDMDAYEQHLQQFVYHSGTTMKPIFQLARSVEPEKKRIVFAEGEEERVLRAMQIIVDEKLAKPILIGRPAVIEQRIARYGLRLVAGQDYTVVNTDHDERYRDFWQEYHRMMSRKGISAQMAKLEMRRRTTLIGAMLVEKGEADGMICGTVSTTHRHLHFIDQVIGRKAGAKVYAAMNALVLPNRQIFLVDTHVNVDPTPEQLAEITIMAAEEVRRFGIEPKVALLSHSNFGTSNAPTAQKMRDTLAILRERAPDLQVDGEMHGDIALDANLRREVMPDSTLEGDANLLVLPNIDAANISYNLLKTAAGNNIAIGPILLGAARPVHVLTASATVRRIVNMTALLVADVIAFPKQAKPGT

SEQ ID NO: 21521 - protein, 518 aa, Zea mays
MDAPGASTTTLLLYGALLLVGFLFIAVARRSNAGLPPGPTGLPLLGSLPSLDPQLHVYFARLAARYGPIFSIRLGSKLGVVVTSPELAREVLREQDLVFSGRDVPDAARSISYGGGQNIVWNPVGPTWRLLRRVCVREMLGPAGLDNVQGLRAREFGATLAHLHAQARAAAPVDVGAQMFLTVMNVITGTLWGGNVGSEGERVALGREFRHLVAEITDMLGAPNVSDFFPALARFDLQGIRNKSDALKERFNQMFARIIEQRVDAERAGGEPPAPDFLEYMLKLEKEGGDGKASFTMTNVKALLMDMVVGGTETTSNTVEWAMAELMQKPELLAKVRQELDAVVGRDAVVEESHLPQLPYLHAVVKETLRLHPALPLMVPHCPSADATVGGYRVPAGCRVFVNVWAIMRDPAVWKDPRDFVPERFLDGAGEGRRWDFTGSEMEYLPFGSGRRICAGVAMAQRMTAYSLAMLLQAFDWELPAGARLELDEKFAIVMKKATPLVAVPTPRLSKPELYYSA

SEQ ID NO: 21522 - protein, 386 aa, Guillardia theta
MAYFKAVAYLAALASAAAFNPGSSFVPRLNAPATQPKAAKMTGPTMQAVPCGINGFGRIGRLVARIMIKDPETKLLQVNAGSATPDYMAYQFKYDSIHGRYQGDVVVDGDDLVIDGQRVITTRARDPKDIGWAKTGVEYLCESTGVFLTAEKAQPHIDAGVKKVIFSAPAKDDSLTVVMGVNAEDYKGQTDFISCASCTTNGLAPLVKCINDKWGIEEGLMTTIHAMTATQAVVDSSSRKDWRGGRAASGNIIPSSTGAAKAVAKVIPAVKGKLTGMAFRVPTIDVSVVDLTCRLAKDATYEEICAEVKRRANGDMKGFLGYTDEPLVSTDFETEPISSTFDAEAGISLNPRFVKLVAWYDNEWGYSNRVKDLMVHVAKVDAKVKA

SEQ ID NO: 21523 - protein, 495 aa, Neurospora crassa
MLTPTTLLLLSPLLYLLTLLFRTALYRLRARSLGCSPVAVYPHKDPILGLDLFRESLRAMNTHALLPLWDARFKRYGNTHYTLTLGKWVLMTNEPENVKVILGTKMAEWPIDGPRLHASVAVLGKKSIFTTNGAQWREARGMIRPSFVRDQVADLHCFAKHVGNFLNAIPKDGSTFDMQELLLSMTMDSSTDFLLGCSTNSLLQPSPEAKQFLEDFEYTSREAAKKSRLGTLLNWLPNGEFQATVTRVREYVRAYIRKSQAEKTDKKERDYVFLHEILKSGADEEHAIDQVLSVIIAGRDTTAAAMTACFYYLARNPEAVKKLRKEIFDMEDEMPTWEQLKNMKYLNMIIKEGLRLFPPASTNSRAPIKDTVLPRGGGPDGKQPILVPKGQVVRWSLYSLHRRKDIWGEDAHEFRPERWDENLRVGWEYIPFSGGPRICLGQQFALTQIEYALFKFFRAFKSIEPRDDNGPLLLRTNLTVTFAKGCLVSATPDSN

SEQ ID NO: 21524 - protein, 355 aa, Botryotinia fuckeliana
MTARAPNPASGSRKISFNVSEQYDIQDVVGEGAYGVVCSALHKPSGQKVAIKKITPFDHSMFCLRTLREMKLLRYFNHENIISILDIQKPRNYESFTEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKKLIYDEIMR

SEQ ID NO: 21525 - protein, 116 aa, Actinidia deliciosa
MVPKPLSLLLFLLLALSAAVVGGRKLVAAGGWRPIESLNSAEVQDVAQFAVSEHNKQANDELQYQSVVRGYTQVVAGTNYRLVIAAKDGAVVGNYEAVVWDKPWMHFRNLTSFRKV

SEQ ID NO: 21526 - protein, 468 aa, Pseudomonas fluorescens PfO-1
MSKSVQLIKDHDVKWIDLRFTDTKGTQHHVTMPARDALEDDFFEVGKMFDGSSIAGWKGIEASDMILLPDDETAVLDPFTEEPTLILVCDIIEPSTMQGYDRDPRAIARRAEEYLKTTGIGDTVFAGPEPEFFIFDEVKFKSDISGSMFKIYSEQGSWMSDQDVEGGNKGHRPGVKGGYFPVPPFDHDHEIRTSMCNALEEMGLTVEVHHHEVATAGQNEIGVKFNTLVKKADETQTLKYVVHNVADAYGRTATFMPKPLYGDNGSGMHVHMSISKDGKNTFAGEGYAGLSDTALYFIGGIIKHGKALNGFTNPATNSYKRLVPGFEAPVMLAYSARNRSASIRIPYVNSPKGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 21527 - protein, 417 aa, Photobacterium profundum
MDSKVVVPVDGQKITLDSEGKLVVPNNPVIPYIEGDGIGVDVSPAMIKVVDAAVNKAYAGDRKIEWMEIYTGEKSTQVYGEDAWLPQETLEFIREYKVAIKGPLTTPVGGGIRSLNVALRQELDLYICVRPVRYFDGVPSPVKRPDLTDMVIYRENSEDIYAGVEYQAGTAEADKVIKFLQDEMGATKIRFTQQCGIGIKPISEEGTKRLIRAALQYTIDNDRDSLTLVHKGNIMKFTEGAFKDWGYEVALQEFGAELLDGGPWMTLKNPNTGKEIVIKDCIADAFLQQILLRPAEYDVIATMNLNGDYVSDALAAQVGGIGIAPGANIGDGVALFEATHGTAPKYAGQDKVNPGSLILSAEMMLRHMGWLEAADLIISSMEAAINNKTVTYDFERQMEGATLRKCSEFADDMIEHM

SEQ ID NO: 21528 - protein, 441 aa, Plocamium cartilagineum
PQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERYLYSMEGVNRSIAASGETKGHYLNVTSATMEEMYERAEFAKEIGSIIIMIDLVIGYTAIQTMAIWARRNDMILHLHRAGNSTYSRQKIHGMNFRVICKWMRMAGVDHIHAGTVVGKLEGDPLMIRGFYNTLLETHLDVNLPQGIFFEQDWASLRKVTPVASGGIHCGQMHQLLDYLGVDVVLQFGGGTIGHPDGIQAGATANRVALESMVLARNEGRDFVTEGPQILQDAAKTCGPLQTALDLWKDISFNYTSTDTADFVETPTSNV

SEQ ID NO: 21529 - protein, 464 aa, Oryza sativa
  unsure (1)..(464): unsure at all Xaa locations
GSGSVALGXLLRREASAERASASASAGAGGRERERRPSVAAGQACRAKKGEDFALLKPACERLPAGGAPFSAFALFDGHNGSGAAVYAKENILSNVMCCVPADLSGDEWLAALPRALVAGFVKTDKDFQTRAHSSGTTVTFVIIDGYVVTVASVGDSRCVLEAEGTIYHLSADHRFDASEEEVGRVTECGGEVGRLNVVGGAEIGPLRCWPGGLCLSRSIGDQDVGEFIIPVPYVKQIKLSSAGGRIIISSDGVWDALTVDTAFSCARGLPPEAAADQIVKEAIASKGLRDDTTCIVIDIIPPEKISPTVQPAKKAGKGLFKNIFYKKATSDSPCHADKDQCTQPDLVEEVFEDGCPSLSRRLDSEYPVRNMFKLFICAICQVELESGQGISIHEGLSKSGKLRPWDGPFLCHSCQEKKEAMEGKRHSRAVSSLPSILHECCCEDWYEFTTCLLVLEYRKMRSP

SEQ ID NO: 21530 - protein, 438 aa, Zea mays
MPAGGFSVSAPSGVEFEAKITPIVIISCIMAATGGLMFGYDVGISGGVTSMDDFLGKFFPAVLRKKLEDKESNYCKYDNQPLQLFTSSLYLAGLTATFFASYTTRRLGRRLTMLVAGVFFIVGVIFNGAAQNLAMLIVGRILLGCGVGFANQAVPLFLSEIAPTRIRGGLNILFQLNVTIGILFANLVNYGTSKIHPWGWRLSLSLAGIPAALLTLGALFVTDTPNSLIERGRLDEGKAVLKRIRGTDNVEPEFNEIVEASRVAQEVKHPFRNLLQRRNRPQLVIAVLLQIFQQFTGINAIMFYAPVLFNTLGFKSDASLYSAVITGAVNVLSTLVSVYSVDRVGRRMLLLEAGVQMFLSQVAIAIVLGIKVTDHSDNLGHGWAIMVVVMVCTFVSSFAWSWGPLGWLIPSETFPLENQSAGQSVTVCVNLLFTFVIA

SEQ ID NO: 21531 - protein, 179 aa, Zea mays
  unsure (1)..(179): unsure at all Xaa locations
MARKFFVGGNWKCNGTAEEVKKIVNTLNEAQVPSQDVVEVVVSPPYVFLPLVKSTLRSDFHVAAQNCWVKKGGAFTXGEVSAEMLVNLDIPWVILGHSERRALLNETNEFVGDKVAYALAQGLSVIACVGETLEQREAGSTMDVVAAQTKAIADRVSNWSKVVIAYEPVWAIGTRKVXS

SEQ ID NO: 21532 - protein, 347 aa, Glycine max
VSASQPLSILFVGGGGADPRLATWSIGSSVTVYQCLDEGDIAVLQSYADEDKNESFYTVGWACNVDGTPLVVAGGLNGVIRVIDAGSEKIHKSFVGHGDSINEVKAQILNPSLVVSASKDESIRLWNAHTGICILIFAGGGGHRNEVLSVDFHPSDMYRICSCGMDSTGKIWSMKEFWTYVEKSSTWTDLPSKFPTKFVQFPVYTASVHINYVDCNTWLGDFILSKSVDNEIILWEPKVNEQTPGKGVVDVLHKYPIPDCNIWFIKFSCDFHFNIVTVGNREGKIFVWELQSSPPVLAAKLSHPQSKSPIRQTATSFDGSTILSCCEDGTIWRWDVSKPSTSTSTAA

SEQ ID NO: 21533 - protein, 525 aa, Emiliania huxleyi
MYGNLCVVGAVGIWLLIATKFEMPVSTTHSCVGGLVGMAIASKGPACVTWYKDPDPDSAKYLPGGITGIVLSWIFSPLLSGLFAVALFAVVRCVVLRSQNSFMRAIKFYPVLIWLAIWINTFFIISKGVSKKVCPSKTNIWICSGYDSDLKEGAEKDAAGGKLSKDDYPGKVNGWVALGFSCGVGLFFAVALIPLYLAIKKRVEAEFADKDTEAGEAEEAKEEAKPPPEPPTTFCGKALAAISYSINRDVHDVKKEETDGVITAIHDNAEKFDPKTEAVFKYIQIFTAICDSFAHGATDVANAMGPFMSIWTIYTNIDTFEFGKGAQKTDLENNDQYWILALGGVGIGLGLLLYGYQIIQAIGVKLAVITPSRGFAIELGAAIVIIIGSYLGIPLSTTHCQVGATTGVALLEGGRGVNKWVLGKTAFGWIITLIIAGILAGILTGQGIRAPLGGAINIAGCSPKVWTDDHPSEWCDTTDPTCDYEGTLPDPNCYIDSPQYIFLDRECPTFIANGPPAPPPPPPLS

SEQ ID NO: 21534 - protein, 423 aa, Bacillus subtilis subsp. subtilis str. 168
MAQGEKITVSNGVLNVPNNPIIPFIEGDGTGPDIWNAASKVLEAAVEKAYKGEKKITWKEVYAGEKAYNKTGEWLPAETLDVIREYFIAIKGPLTTPVGGGIRSLNVALRQELDLFVCLRPVRYFTGVPSPVKRPEDTDMVIFRENTEDIYAGIEYAKGSEEVQKLISFLQNELNVNKIRFPETSGIGIKPVSEEGTSRLVRAAIDYAIEHGRKSVTLVHKGNIMKFTEGAFKNWGYELAEKEYGDKVFTWAQYDRIAEEQGKDAANKAQSEAEAAGKIIIKDSIADIFLQQILTRPNEFDVVATMNLNGDYISDALAAQVGGIGIAPGANINYETGHAIFEATHGTAPKYAGLDKVNPSSVILSGVLLLEHLGWNEAADLVIKSMEKTIASKVVTYDFARLMDGATEVKCSEFGEELIKNMD

SEQ ID NO: 21535 - protein, 456 aa, Splachnidium rugosum
YNVKDTDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVIVERERLDKFGRPLLGATVKPKLGLSGKNYGRVVYEGLCGGLDFLKDDENINSQPFMRWKERFLYCMEGVNRAAAATGEVKGSYLNITAATIEQMYERAEYAHAIGSVIVMIDLVIGYTAIQTMAIWARKAEMILHLHRAGNSTYARQKNHGINFRVICKWMRMCGVDHIHAGTVVGKLEGDPLMVRGFYNSLLLTHLKINLAEGLFFDMDWASLRKCVPVASGGIHCGQMHQLLYYLGDDVVLQFGGGTIGHPDGIQSGATANRVALEAMVLARNEGRDYVGEGPQILRNAANSCGPLKAALDLWKDITFDYTSTDTPDFVETSTESR

SEQ ID NO: 21536 - protein, 356 aa, Lactobacillus plantarum WCFS1
MKASIEQLEPYVPEKPLATLQAELGLTELVRLSANENPYGTSPKVATAVKNWDFTQSNRYPDADAQELRQAVAQQQGIDPNSIVFSVGLDEMIVMLSRTFLATNDQVLVSAPTFSEYGLHAEIEGGQLISVPTLPNDHVNFEGLMKAITPHVKMVWLCNPNNPTGTVESLAAIEAFVQQVPPETMVLIDEAYIDFTPGAAQVTAMQLPAKYPNVVVMRTFSKAYGLANFRIGYAVFNTKYAATMQTIRLPYNVNSLAQVAALAAIDDPNFVKQTVQKNATERAKWMAFFDDQGVTYDQSGANFIFFKYPSATQLADYLVHHGYLIRTGLRPGWLRLTVGTANDNQQLQQLIREFKA

SEQ ID NO: 21537 - protein, 375 aa, Clostridium tetani E88
MMTLRHGGDIYTDGILKGRKLIDFSSNINPLGIPKSFTENIQEAIDNLNKYPDIKYRTLKGNIVEYINKSKVLFQRDEKVIENGYIEIVDENSIVLGNGAAEIIDLVISTLKRIMIITPSFGEYEENAEKYGCEILYVNSTKNMDYDYESILNNLNRVDGIILGNPNNPDGRILKEEEFKPILDYCEKNNKLVIIDEAFIEFVGDMSKSYVEKIKNYKCLFIIRALTKFYSMPGIRFGFGISRDKKVIEEIKSLQNPWNINAFAEVAAKYVLKDKEYIKKSLQWITEERETLLEEIRKLGFIEKAYNSNGNFILCKLKNIDCEELYDLCLKEDIVIRKCDNYKGLDKSFVRVAIKDRQTNKILIDKLNKIWRDFK

SEQ ID NO: 21538 - protein, 257 aa, Cladonia arbuscula
AYMLKYDSQHGQFKGTIEVEGSDLIVNGQKVKFYTEKDPGAIPWKDTGAYYIVESTGVFTTTEKAKAHLKGGAKKVVISAPSADAPMFVMGVNEETYKSDIEVISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDEIKEAMKKASDGELKGIMAYSEDDLVSTDLNGDNHSCIFDAKAG

SEQ ID NO: 21539 - protein, 427 aa, Arabidopsis thaliana
MDPYKYRPSSAYNAPFYTTNGGAPVSNNISSLTIGERGPVLLEDYHLIEKVANFTRERIPERVVHARGISAKGFFEVTHDISNLTCADFLRAPGVQTPVIVRFSTVVHERASPETMRDIRGFAVKFYTREGNFDLVGNNTPVFFIRDGIQFPDVVHALKPNPKTNIQEYWRILDYMSHLPESLLTWCWMFDDVGIPQDYRHMEGFGVHTYTLIAKSGKVLFVKFHWKPTCGIKNLTDEEAKVVGGANHSHATKDLHDAIASGNYPEWKLFIQTMDPADEDKFDFDPLDVTKIWPEDILPLQPVGRLVLNRTIDNFFNETEQLAFNPGLVVPGIYYSDDKLLQCRIFAYGDTQRHRLGPNYLQLPVNAPKCAHHNNHHEGFMNFMHRDEEINYYPSKFDPVRCAEKVPTPTNSYTGIRTKVRFLPCLL

SEQ ID NO: 21540 - protein, 920 aa, Neurospora crassa
MTSLSSIAVGGGPFERDTDPNPSPSSSIDSNTTPDTDFTPMGSPFQEVAVPKNKRTKSIPEKGIPAVKTSDGPNGARGGIFVGGTKAALFPCGISLAATWNKALLREVGRHLAEEAKARQANILLAPTVCMHRHPLGGRNFESFSEDPLLTGKLAAQYIKGLQERGVAATIKHFVGNEQETHRLTVNSVIAERPLREIYLRPFEIAVREAKPWAVMSSYNLVNGVHADMNTHTLKEVLRDEWKFDGAVMSDWGGVNSTAESIKAGCDIEFPHSKKWRYEKVMEALNKGELSQADIDRAAENVLTLVERTKGSDLTPEAAEREDDREETRELIREAGIQGLTLLKNEGSILPINPKTTKVAVIGPNANRAIAGGGGSASLNPYYTTLPLDSIRKVAEKPVTYAQGCHIYKWLPVASPYCSDKTGKPGVTIEWFKGDKFKGEPVVIQRRTNTDLFLWDSAPLAQTGPEWSAIATTYLTPKHSGKHTISYMSVGPGKLYINGKLSLDLWDWTEEGEAMFDGSVDYLVELEMVANRPVELRVEMTNELRPLSKQKQMGMTHRYGGCRIGYKEADQIDYLQQAIAAASSADVAIVIVGLDAEWESEGYDRQTMDLPYNGSQDRLIEAVVAANPNTVVVNQSGSPVTMPWADRVPAILQAWYQGQEAGNALADVLFGLRNPSGKLPCTFPKRLEDTPAYHNWPGENLEVIYGEGIYIGYRHYDRTKIAPLFPFGHGLSYTKFEYGRPSLSSRVLRENGVIELCVAISNVGEYDGAETVQVYVRDEKSKLPRPEKELVAFEKVALERGETKHLRMELDKYAVGYYDTDKKGWVAEEGRFVVLVGSSAGDIKTIALSKRYLHSHSFRLLRPSRGAEIDLPMAERRIYPIPLADTDQSLYIKENGLGDFDEMIMKDIKMADFYVQVVNG

SEQ ID NO: 21541 - protein, 225 aa, Oryza sativa; identical to SEQ ID NO: 12519

SEQ ID NO: 21542 - protein, 759 aa, Rhodobacter sphaeroides
MDEARQDNARHAALDYHEFPKPGKLEIRATKPLANGRDLARAYSPGVAEACLEIKADPATASRYTSRGNMVGVVTNGTAVLGLGNIGALAAKPVMEGKAVLFKKFAGIDCFDIELAEPDPLKLAEIVCALEPTFGAINLEDIKAPDCFIVEKICRERMNIPVFHDDQHGTAIVVGAAATNALHVAGKRFEDIKVVSTGGGAAGIACLNMLLKLGVKRENVWLCDIAGLVWKGREAEMTPQKAEYAQDSDLRTLAEVIEGADLFLGLSGPGVLTPAMVERMAERPIIFALANPTPEILPDEVRSVRPNAIIATGRSDYPNQVNNVLCFPFIFRGALDVGATTINDEMQLACIEGIASLARATTSAEAAAAYKGEPMSFGADYLIPKPFDPRLIGVVALAVARAAMESGVATRPIADLDAYRRRLEGSVFRSALIMRPVFEASAAESRRIVFAEGEDERVLRAANAVLEETVHKPILIGRPEVVEMRCERAGLPIRPGRDFDLVNPENDPRYRDYWESYHALMARRGVTPDTARAVMRTNTTAIGAIMVHRGEADSLICGTYGQYLWHLNYVTQILATRNRRPIGALSLMILEDGPLFVADTHVHHEPTPEEIAETVIGAARHVRRFGLAPKVALCSSSQFGNLDCSTGRRMRAALEILDERRVDFAYEGEMHIDAALDQAIRDRIFPGGRFDGPANVLVFGNSDAASGVRNILKVKANGLEVGPILMGMGNLAHIVTASITARGLLNMSALAGTPVTHYG

SEQ ID NO: 21543 - protein, 336 aa, Staphylococcus aureus subsp. aureus MW2
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMENGTITGRMVIKF

SEQ ID NO: 21544 - protein, 397 aa, Gossypium hirsutum
MALNFNAIASKSQKLPCFALPPKATLRSPKFSMISTIPSGSKEVGNLKKPFTPPKEVPVQITHSMPPHKIEIFKSLEGWAENNILTHLKPVEKCWQPADFLPDPNSDGFHEQVKELRERAKEIPDDYFVVLVGDMITEEALSTYQTMLNTLDGTRDETGASLTPWAIWTRAWTAEENRHGDLLNKYLYLSGRVDMRQIERTIQYLIGSGMDPHTENSPYRGFIYTSFQERATFISHGNTGRLAKEYGDINLAQICGSIASDEKRHETAYTKIVEKLFEIDPDETVLAFADMMKKKIAMPAEFIYDGRDYNLFDHYSAVAQRIGVYTAKDYVDIVEHLVDRWKVKELAGLSAEGRKAQDYLCSLPSRIRRLEERAQEKAQGSTPVSPFSWIFDREVKL

SEQ ID NO: 21545 - protein, 258 aa, Trichodesmium sp. IMS101
FGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAERLEFRCPDATCNPYLAFAAMLCAGIDGI

SEQ ID NO: 21546 - protein, 325 aa, x Doritaenopsis sp.
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDREWIEVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 21547 - protein, 346 aa, Triticum aestivum
  unsure (1)..(346): unsure at all Xaa locations
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSEEDEKATFVDPKLRGKYCVCFDPLDGSSNIDCGVSIGTIFGIYMIKNQDTVTLEDXVLQPGKDMIAAXGYCMYGSSCTLVLSTGNGVNGFTLDPSLGEFIMTHPDIKIPPKGKIYSVNEGNAKNWDTPTAKYVEKCKYPTDGSSPKSFRYIGSMVADVHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 21548 - protein, 253 aa, Zea mays; identical to SEQ ID NO: 3990

SEQ ID NO: 21549 - protein, 211 aa, Populus alba
AQAAAALENKKQVCVNVEKVPAAGVDGVDAVGRKVAVKKPAQKKVTVKPKPEEVVVISPDSEEVVKQEKPVKKKKEGEGSKKNKPTLTSVLTARSKAACGIANKLKEQIIDIDAADVNNDLAGVEYVEDIYKFYKLVENESRPNNYMDMQPEINEKMRAILVDWLVDVHQKFQLSPETFYLTINIIDRFLSVKTVPRRELQLVGIGATLMA

SEQ ID NO: 21550 - protein, 415 aa, Nitrosomonas europaea ATCC 19718
MYQHIKVPTTGSKIRVKDDSSLVVPDNPIIPFIEGDGIGVDITPVMISVVDGAVKKAYGDSRKISWMEIYAGEKSTRVYGQDIWLPDETLQAAKEFVVSIKGPLTTPVSGGIRSINVALRQLLDLYVCLRPVRYFQGVPSPVKQPEKVDMVIFRENSEDIYAGIEWEAGTEAVEKVINFLTAEMGITKIRFPRSSAIGIKPVSKEGSERLIRKAIQYAIDHKRRSVTLVHKGNIMKFTEGAFKKWGYELAAKEFGAELLDGGPWMILRHNGNEIIIKDVIADAFLQQILLRPDEYDVIATLNLNGDYISDALAAQVGGIGIAPGANMSDSIAIFEATHGTAPKYAGKDQVNPGSIILSAEMMLRHIGWHEAANIVISSMEKTIQDRIMTYDLARLTPNAKQATSSEFGNAMVARM

SEQ ID NO: 21551 - protein, 519 aa, Ipomoea nil
MATLTLIFCTLVFAIFLYFLILRVKQRYPLPLPPGPKPWPVLGNLPHLGKKPHQSIAAMAERYGPLMHLRLGFVDVVVAASAAVAAQFLKVHDSNFSNRPPNSGAEHIAYNYQDLVFAPYGPRWRMLRKITSVHLFSAKALDDFCHVRQEEVATLTRSLASAGKTPVKLGQLLNVCTTNALARVMLGRKVFNDGGSKSDPKAEEFKSMVEEMMVLAGSFNIGDFIPVLGWFDVQGIVGKMKKLHARFDAFLNTILEEHKCVNNQHTTLSKDVDFLSTLIRLKDNGADMDCEEGKLTDTEIKALLLNLFTAGTDTSSSTVEWAIAELLRNPKILNQAQQELDLVVGQNQLVTESDLTDLPFLQAIVKETFRLHPSTPLSLPRMGAQGCEINGYFIPKGATLLVNVWAIARDPNVWTNPLEFNPHRFLPGGEKPNVDIKGNDFEVIPFGAGRRICSGMSLGIRMVHLLVATLVHAFDWDLVNGQSVETLNMEEAYGLTLQRAVPLMLHPKPRLQPHLYTLN

SEQ ID NO: 21552 - protein, 921 aa, Oryza sativa (indica cultivar-group)
MASKGTGGGHGGVERKEQQQQRGYQLPRDSRGSLEVFNPSSASSFRTAAAAAKSASPFLAIPDREEDNVVAQQRAAEWGLVLQTDYHTGLPQGVSTRPSSCSARTSSEDTPQQQQSAAAIPRVSEELRAALSAFQQTFVVSDATRPNHPIMYASAGFFNMTGYTSKEVVGRNCRFLQGSGTDPHEIDKIRQALANGSNYCGRILNYKKDGTPFWNLLTIAPIKDEDGRLLKFIGMQVEVSKYTEGKKETVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRAIVRKIRDAIDNQAEVTVQLINYTKSGKKFWNLFHLQPMRDQKGDVQYFIGVQLDGTEHVQDDAAEEGVVLVKKTADNIDEAAKELPDANLRPEDLWANHSKVVLPNPHMKDTASWRAIQKVLESGESIGLKHFRPIKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYVAEVVIALEYLHCQGIIYRDLKPENILLHRDGHISLTDFDLSCLTSCRPQVFLPEDADEKKGRKNRSYPIFFAEPMRASNSFVGTEEYIAPEIITGAGHTSAVDWWALGILLYEMLYGYTPFRGKTRQRTFANILHKDIRFPASILVSLAARQLMYRLLHRDPANRLGSYEGANEIKGHPFFRGINWPLIRATAPPKLEIPLFSKDDMEKKGLVTDNRTDIF

SEQ ID NO: 21553 - protein, 822 aa, ASPERGILLUS NIDULANS FGSC A4
MTIMTSASQILVWGLLAASGAQAQNYGGGSSRSDDAFSYVQPKNTTILGAYGHSPAVYPSPNTTGSGGWETALAQAQDFVAQLTLEEKANMVTGQPGPCVGNIIAIPRLNFSGLCLQDGPLAIRVTDMASVFSAGVTAAASWDRKILYERGYAMGQEFKAKGAHVALGPVAGPLGRSAYSGRNWEGFAADPYLTGVAMEETIQGYQDAGVQACPKHFIGNEQETMRNPTFNDSAPLGTVIQEAVSSNIDDRTMHELYLWPFANAVHAKAASIMCSYQRINGSYGCENSKTLNGLLKGELGFQGYVMSDWGATHSGVAGIKSGQDMDMPGGLGAYGQTFINRSFFGGNVTAAVNNGTLEESRIDDMILRIMTPYFWLGQDQDYPTVDPSTADYNTFSPRNTWYQDFNLTGERSRDVRGNHAALIRKQAAEATVLLKNKNNALPLKAPKTLAVFGNDASDITNGPYNDATYEYGTLAAGGGSGTGRFTYLVSPLTAINARAQKDNTSLVQFWLNNTQIATSDVQADLLRVPTPPTACLVFVKTWAEEGADREHLRLDYNGTEVVEAVAAACNNTIVVTHSSGINELPFANHPNVTAILAAHFPGQESGNSIVDVLYGDVNPSGRLPYTIARNGSDYNAPPTTAVTTSGREDWQSWFDEKLEIDYRYFDAHNIPVLYEFGFGLSYTTFNISDIYATRVVDSITSAPEDRAIQPGGNPELWETIYNVTVSVTNTGDVEGATVPQLYVTFPDSTPEGTPPKQLRGFDKVSLQPGESTKVIFELMRRDLSYWDTVSQQWLIPEGDFTIRVGFSSRNLKEVTTITPVSE

SEQ ID NO: 21554 - protein, 442 aa, Zea mays
MASRNHNAAAPQLHHHNRAGVPALGKAKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 21555 - protein, 471 aa, Fremyella diplosiphon
MTTPQEVLKLIQDQKIQMIDLKFIDTPGTWQHLTVYYNQIDESSFTDGVPFDGSSIRGWKGIEESDMTMVLDPNTAWIDPFMKEPTLSIICSIKEPRTGEWYNRCPRVIAQKAIDYLVSTGLGDTAFFGPEAEFFIFDDARFDQTANSGYYYVDSVEGRWNSGKDEGPNLAYKPRFKEGYFPVAPTDTFQDMRTEMLLTMAACGVPIEKQHHEVATGGQCELGFRFGKLIEAADWLMTYKYVIKNVAKKYGRTVTFMPKPIFGDNGSGMHCHQSIWKDGKPLFGGDKYAGLSDMALYYIGGILKHAPALLGITNPTTNSYKRLVPGYEAPVNLAYSQGNRSASVRIPLSGTNPKAKRLEFRCPDATSNPYLAFAAMLCAGIDGIKNKIHPGEPLDRNIYELSPEELAKVPSTPGSLELALEALENDHAFLTESGVFTEDFIQNWIEYKLVNEVKQLQLRPHPYEFYLYYDC

SEQ ID NO: 21556 - protein, 376 aa, Arabidopsis thaliana
MSAESCFGSSGDQSSSKGVATHGGSYVQYNVYGNLFEVSRKYVPPLRPIGRGAYGIVCAATNSETGEEVAIKKIGNAFDNIIDAKRTLREIKLLKHMDHENVIAVKDIIKPPQRENFNDVYIVYELMDTDLHQIIRSNQPLTDDHCRFFLYQLLRGLKYVHSANVLHRDLKPSNLLLNANCDLKLGDFGLARTKSETDFMTEYVVTRWYRAPELLLNCSEYTAAIDIWSVGCILGETMTREPLFPGKDYVHQLRLITELIGSPDDSSLGFLRSDNARRYVRQLPQYPRQNFAARFPNMSAGAVDLLEKMLVFDPSRRITVDEALCHPYLAPLHDINEEPVCVRPFNFDFEQPTLTEENIKELIYRETVKFNPQDSV

SEQ ID NO: 21557 - protein, 347 aa, Pedinomonas minor
LELRDGDKTHYMGKSVEKAVDNINKLISPALVGMNPVNQREIDNAMMKLDGTDNKGKLGANAILAVSMAVCKAGAAEKGVPLYKHIADVAGVKKLVLPVPAFNIINGGMHAGNNMPMQEFMVLPTGAKSFKEAMKMGCEVYHTLRTLIKKKYGQDACNVGDEGGFAPNVASAEEALKMVDQAINDAGYKGKVTIGMDVAASEFYTQDKCYDLGFKMKNNDGSLKMTGKQMQELYAKFCKEFPIISIEDPFEQDDFANWTEITAANSCQIVGDDHLVTNPKRVKQAIEAKSSNALLLKVNQIGTISESIDAVRMSKEAGWGVMTSHRSGETEDSFIADLAVGLATGQI

SEQ ID NO: 21558 - protein, 519 aa, Vitis vinifera
MPAVGGFDKGTGKAYPGNLTPYVTVTCVVAAMGGLIFGYDIGISGGVTSMAPFLQKFFPSVYRKEALDKSTNQYCKFDSETLTLFTSSLYLAALLSSLVAATVTRKFGRKLSMLFGGLLFCAGAIINGAAKAVWMLIVGRILLGFGIGFANQSVPLYLSEMAPYKYRGALNIGFQLSITIGILVANILNYFFAKIKGGWGWRLSLGGAVVPALIITVGSLVLPDTPNSMIERGQHEGAKTKLRRIRGVDDVEEEFNDLVVASEASKLVEHPWRNLLQRKYRPHLTMAILIPFFQQLTGINVIMFYAPVLFKTIGFADDASLMSAVITGRVNVLATIVSIYGVDKWVRRFLFLEGGTQMLICQVIVATCILVKFGVDGEPWCLPKWYAIVVVLFICVYVSGFAWSWGPLGWLVPSEIFPLEIRSAAQSVNVSVNMFFTFIIAQIFLNMLCHMKFGLFLSFAFFVVVMSFFIYFFLPETKGIPIEEMAEVWKSHWFWSRYVNDGSYSGVELVKENYPVKNV

SEQ ID NO: 21559 - protein, 468 aa, Neisseria meningitidis
MSIKDAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTKFSTLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEM

SEQ ID NO: 21560 - protein, 488 aa, Chordaria flagelliformis
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVGYEGLTGGLDFLKGDENINSQPFMRWKERFLYCMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 21561 - protein, 363 aa, Paracoccidioides brasiliensis
MGVKDLLSRKTGVIVGDDVLRLFQHAQENVFAIPAIMVTSSSTGSALEAARDKSPIVLQTSNGAAYFAGKGKGVSNDGQSVAGSIAIAAAHYIRSQAPAYGIPVVLHTDHCAKKLLPWLDGMLDADECYSKLHNEPLFSSHMIDLSEESVEWNIETTAKYLKRAAPMKQWLEMEIGITGGEEDGVNNESVDNNSLYTQPEDIYTIYKTLSAISPYFSIAAGFGNVHGVYRGDIALRPLLRHLHNAKYDEQLKCLQDPLGFFVFHGGSGSSHQPATSITSEFAAKGRVDLEKVAYLPGTSSLVIAPKDYLMSPYGIPVVLHTDHCKYFDPRVQIREGLKHMSARVQEAKDDFNDSNQAKKLLPW

SEQ ID NO: 21562 - protein, 113 aa, Triticum aestivum
  unsure (1)..(113): unsure at all Xaa locations
MEATIHSVMARRIFDSRGNPTVXGDVCCSDGTFARAGASSGAXTGVYEAVELSDCXSDYLGKGVYKADDNVNSIIAPAVIGKDPTVQTELDNFMVQPLDGSKNEWRWRKHNPG

SEQ ID NO: 21563 - protein, 308 aa, Sorghum bicolor
MEINIVDKYEKLEKVGEGTYGKVYKAQDKATGQLVALKKTRLEMDEEGIPPTALREISLLNLLSHSIYVVRLLAVEQAAKNGKPVLYLVFEFLDTDLKKYLDVYRRGPAARPLPATLIKNFLYQLCKGVAHCHGHGVLHRDLKPQNLLVDKDKGILKIADLGLGRAFTVPMKSYTHEIVTLWYRAPEVLLGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 21564 - protein, 361 aa, GIBBERELLA ZEAE PH-1
MAEYEFKGWLGKDAESANGKMEWGSFEPKKWEENDVDIKITHCGVCGSDLHTLRSGWGETPFPCCVGHEIVGKAVKVGKNVKNIKVGDRVGVGAQARSCLREDCIECSAGRVNYCDNMVSTYGSVYPDGIGKSYGGYADYNRTDSRFVVKIPEALPSELAAPMLCGGVTVYAPLRNNGCGPGKTVGIVGVGGLGHFGILFAKALGADKVVGISRKASKRDEVLALGADSYIATDDDEDWANKYAKTVDIIVCTVSSSKMPFSDYFKLLRHGGNFIQVGAPDSGLLPPVNAFTLIKGGFKLSGSLIGSPADIEEMLELAVKKNVKPWIEKRPMEDANQTIIDIEEGKARYRYVLVNQKNIEQ

SEQ ID NO: 21565 - protein, 197 aa, Brassica napus
MGRKKLEIKRIENKSSRQVTFSKRRNGLIEKARQLSVLCDASVALLVVSASGKLYSFSSGDNLVKILDRYGKQHDDDLKALDRQSKALDCGSHHELLELVESKLEESNVDNVSVGSLVQLEEHLENALSVTRARKTELMLKLVENLKEKEKLLEEENHVLASQMEKSNLVRAEADNMDVSPGQISDINLPVTLPLLN

SEQ ID NO: 21566 - protein, 762 aa, GIBBERELLA ZEAE PH-1
MGSSDIIDHSPHQGDPSPPIPTASNLIVIDNYDSFTWNIYQYLVLAGATVTVYRNDKVTVEELVAKKPTQIIISPGPGHPETDSGVSRDVIKHFAGKVPIFGVCMGLQCIFNVYGGEVSSAGEWLHGKTSPLTHDSKGVFSGLSQGVPVTRYHSLAGTHVTLPEDLEISSWVAKPDGSPGVIQGVRHKKYTIEGVQFHPESILTEGGRAMITNFLHMQGGTWEENTQFQKSGTVASDNSAAPKSKKTNNILQRIYANRKAAVDAQKQIPSQRFEDLQVAYDLNAAPPQIPLVSRLRESPFDVALMAEIKRGSPSKGIFALDISAPAQARKYALAGASVISVLTEPEWFKGSIEDLRAVRQVLDGMPNRPAILRKEFIFDEYQILEARLAGADTVLLIVKMLDTELLHRLYNYSLQLGMEPLVEVQNAEEMTTAVKLGAKVIGVNNRNLESFEVDLNTTGRLRSMVPESTIICALSGINTHDDVLMNKRDGVNAVLVGEAIMKAPDASVFISQLCSGTEPAAKTGVAPSLYVKICGTRSAEAARRAAESGADFVGICLVPSAKRCISHETALAISEAVHTFSSTRKYETQVSAVDNKAKDFFEAATQRLSSPRPQLVGIFQNQPLSEVLEKQKQYNLDLVQLHGDEPIEWANLIPVPVVRCFKPSQVGIGRRGYHTVPLLDSGSGSGKLLNVANVQAVLESDPELRVFLAGGLNPDNVAESVKALGPLADRVIGVDVSSGVEEDGKQSLDKITAFIKAAKEIR

SEQ ID NO: 21567 - protein, 492 aa, Triticum aestivum
  unsure (1)..(492): unsure at all Xaa locations
VRRARVVLGRRRRRRDAELLGAAEAERKKKVAAXIEDXERTLATPTALLRGISDALVLEMERGLRGDMHSQLKMLISYVDNLPTGDEHGLFYALDLGGTNFRVLRVQLGGREKRVAKQQYQEVSIPPHLMVGTSLELFDFIAAVLAKFVETEGDEFHLPMGRQRELGFTFSFPVNQLSISSGTLIKWTKGFSINGAVGEDVVAELSKAMERQGLDMKVSALVNDTVGTLAGGRYMDNDVVAAIILGTGTNAAYVEHANAIPKWTGLLPKSGNMVINTEWGSFKSDKLPLSEYDKALDFESLNPGEQIYEKLISGMYLGEIVRRILLKLAHDAALFGDVVPAKLELPFVLRTPDMSAMHHDASHDLKILGSKLKDIVGVADTSLEVRYITRHICDIVAERGARLAAAGIYGILKKLGRDKVPTDGSPMPRTVVALDGGLYEHYKKFSSCLEATLSDLLGDEASSSLVAKLANDGSGIGAALLAASHSQYADIY

SEQ ID NO: 21568 - protein, 304 aa, Oryza sativa
MWKLKIAEGGPWLKSGNSHVGRETWEFDPNFGTSEEREAVEAARIEFQKNRFRTRHTSDVLARMQLAKANNFSIDLQKEKDGNPINIDTATVSDILKKALSYFSAIQAYDGHWPGDFPGPLFTTATMIIVLYVTESLTITLSSEHHKEICRYLYNRQVLGVFDWSGVNPIPPELFLLPSFVPIQPGRLWSHFRMAFIPMSYLYGKKFVGPITRLVISLREELHIHPYKKIDWKEARKLCAKEDAYNPHMWLQECLSDCLYSFGEPFLTRWPISYMRKRALYQIAEFLKYEDENSQYICIGAAQK

SEQ ID NO: 21569 - protein, 189 aa, Zea mays
MGPVPGQGGALGTRIPDGWGRRADPEREARFREEWITVFGFSIGVTNLVLREFEKCGVILRHHSGPRDGNWIHILYERSYDARKALQKNGMQLSNSLIVGVKPIDAVHRQQLDKGFAQSNQGGFMVSLPSKSLGLKSAGASNQLGALPRPYDPKANTNVSRDAGRRATGSVAAPAKSIVTNVMDLIFGI

SEQ ID NO: 21570 - protein, 345 aa, Prochlorococcus marinus subsp. pastoris str. CCMP1378
METHVERISNLQDFKKAKLDRETGLFLYEDMTLGRRFEDKCAEMYYRGKMFGFVHLYNGQEAISTGVIGAMKRKHDWFCSTYRDHVHALSAGVPSFEVMSELFGKATGCSKGRGGSMHLFSKEHHLLGGYAFIGEGIPVALGSAFSSKYKKEVVGDNQSDSVTAAFFGDGTCNNGQFFECLNMAQLWKLPIIFVVENNKWAIGMAHDRATSNPEIWRKASAFGMHGEEVDGMDVLAVRGAAQRAVERARAGEGPTLLECLTYRFRGHSLADPDELRAEEEKEFWAKRDPIKKLANQIIEGNFAQEEELKSIEKKIDLEISESVKNALDAPEPPSNELTKYIWAED

SEQ ID NO: 21571 - protein, 335 aa, Haloarcula vallismortis
MMSEPVRVGLNGFGRIGRNVFRASLHSDDVEIVGINDVMDDSEIDYFAQYDSVMGELEGASVDDGVLTVDGTDFEAGIFHETDPTQLPWDDLDVDVAFEATGIFRTKEDASQHLDAGADKVLISAPPKGDEPVKQLVYGVNHDEYDGEDVVSNASCTTNSITPVAKVLDEEFGINAGQLTTVHAYTGSQNLMDGPNGKPRRRRAAAENIIPTSTGAAQAATEVLPELEGKLDGMAIRVPVPNGSITEFVVDLDDDVTESDVNAAFEDAAAGELEGVLGVTSDDVVSSDILGDPYSTQVDLQSTNVVSGMTKILTWYDNEYGFSNRMLDVAEYITE

SEQ ID NO: 21572 - protein, 337 aa, Synechocystis sp. PCC 6803
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPFGKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 21573 - protein, 344 aa, Synechococcus sp. PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 21574 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 21575 - protein, 410 aa, Zea mays
  unsure (1)..(410): unsure at all Xaa locations
MAAAGEGEAERVSALLREITGEGGFAFVASADKAGAGDLRAAEAAREMAWEQLHSGPWSEVGTAWRDAYALACLNVARLRTHAASGGDSDRSAALRALDMGLIMGGNLLRADLEAALARISAEACGGSEGGEGVVDKEDQRWREALDRNRDIADALKILPANSLSCKKVERRSCISLEEFICNYFLRDTPVIISGTIEHWPARTKWKDIEYLKKVAGDRTVPVEVGKNYVCSEWKQELITFSQFLDRMSSTVCPSNLTYLAQHPLFEQIKELSEDIIVPEYCYAGGGELQSLNAWFGPEGTVTPLHHDPHHNILNGCTHVITIRLYPAFIAEDLYPHTETLXCRPSSCHVILDSIDXRMSSRLQCQILEIVKKXKKLYIPPKWWHYVRSLSTSFSVSFWWRAAVQPSGGS

SEQ ID NO: 21576 - protein, 319 aa, Brassica napus
MEICTYFKSQPTWLLVLFSLGSISILRFTFTLLTSLYIYFLRPGKNLRRYGSWAIITGPTDGIGKAFAFQLAQKGLNLVLVARNPDKLKDVSDSIQAKYSNTQIKTVVMDFSGDIDGGVRRIKEAIEGLEVGILINNAGVSYPYAKYFHEVDEEMLGNLIKINVEGTTKVTQAVLVNMLKRKRGAIVNMGSGAAALIPSYPFYSVYAGAKTYVDQFSRCLHVEYKKSGIDVQCQVPLYVATKMTKIRRASFLVASPEGYAKAALRFVGYEPRCTPYWPHALMGYVVSALPESVFESFNIKRCLQIRKKGMLKDSISKKE

SEQ ID NO: 21577 - protein, 304 aa, Zea mays
  unsure (1)..(304): unsure at all Xaa locations
MAGMSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMVLLNGGVFXVILLLTLLLFKGSKRVVLLGWICVGFXPVSVFVAPLSIMRRVIQTKSVEYMXPFSLSLSFTLSAVVWFLYGLLIKDKYVALPNILGFTFGVVQMVLYVLYMNKTPVAATAEGKDAGKLSSAADEHVLVNIAKLSPALPERSSGVHPVTQMAGVPVRSCAAEATAPAMLPNRDVVDVFVTRHSPAVHVA

SEQ ID NO: 21578 - protein, 354 aa, Schizosaccharomyces pombe
MTIFNGLSESGESKKLNSKIEKQIENASKKDKKIYKVLLLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERNRLVESISLFDSIINSQWFMHSSIILFLNKFDLFRKKLEHVPFQDYFPQYEGKNSVKSITRYILWLFVNPSINRAKHNIYPHITTAVDTSNIKVVFSAVKETILQHSLKEAGMF

SEQ ID NO: 21579 - protein, 294 aa, Bacillus amyloliquefaciens
MRFVTHFERKAGGAELNFAIACARLNLHSKWVSRLGKDEFGRVIYQFARGEGIDVTDVSYVEGFPTSLNVKEIRNDGSGKTFYYRFNSPILTLAPEDITENMFDGIHIVHLTGVFLALDKKNLEIAERVLSIAKARKIPVSFDPNIRLKLWTIEEARAAFHQIFPHTDILLAGRDEMKQLTGIGENEALARFAETYSISQLVIKDGESGSALYHDHKWIHKEAFPVAPVDTVGAGDGFNAGYLYSYLHGFEPEKRLEFANAVGALVTTVSGDNEGLPYLEEVLSFVNKETVIDR

SEQ ID NO: 21580 - protein, 484 aa, Proteus mirabilis
MEKKKLTTAAGAPVVDNNNVITAGPRGPMLLQDVWFLEKLAHFDREVIPERRMHAKGSGAFGTFTVTHDITKYTRAKIFSEVGKKTEMFARFSTVAGERGAADAERDIRGFALKFYTEEGNWDMVGNNTPVFYLRDPLKFPDLNHIVKRDPRTNMRNMAYKWDFFSHLPESLHQLTIDMSDRGLPLSYRFVHGFGSHTYSFINKDNERFWVKFHFRCQQGIKNLMDDEAEALVGKDRESSQRDLFEAIERGDYPRWKLQIQIMPEKEASTVPYNPFDLTKVWPHADYPLMDVGYFELNRNPDNYFSDVEQAAFSPANIVPGISFSPDKMLQGRLFSYGDAHRYRLGVNHHQIPVNAPKCPFHNYHRDGAMRVDGNSGNGITYEPNSGGVFQEQPDFKEPPLSIEGAADHWNHREDEDYFSQPRALYELLSDDEHQRMFARIAGELSQASKETQQRQIDLFTKVHPEYGAGVEKAIKVLEGKDAK

SEQ ID NO: 21581 - protein, 349 aa, Escherichia coli K12
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 21582 - protein, 414 aa, Thermus caldophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKGVIPRAIRVGYRVYAYDFHRNPIPGQEGPNLYWRDVGTLDAYYEASMDLVKVDPVFGLCSPVWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 21583 - protein, 186 aa, Glycine max
DQNGEFSFRRGWKKKSTHSIGSDMWSGDLFSRELSSTTSMRGTLCYVAPEYGGCGFLMEKADIYSFGVLILVIVSGRRPLHVLASPMKLEKANLISWCRHLAQDGNILELVDERLKEDYKKEQASLCINLALICLQKIPELRPDIGDIVKILKGEMELPPLPFEFSPSPPSKLYSRSRRKPKGTAE

SEQ ID NO: 21584 - protein, 137 aa, Oryza sativa (japonica cultivar-group)
MAEEGQRGGYSRLAGDEEVATASGGGGGDYDERKLRLLGYEPQLKRNLSLLSNFAVSFSIVSVLTGITTLFGTGLQFGGPATMVYGWPIAGAMTLVVGLAMAEICSAYPTSGGLYFWSARLCSHRRWGPFASWLTGW

SEQ ID NO: 21585 - protein, 72 aa, Triticum aestivum
IIKKENNFKQAGERYRSFDPARQDRFLQRWVDALTDARVTHEIQGIWVSYWSQCDASLGQKLASRLKMKPNM

SEQ ID NO: 21586 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 21587 - protein, 183 aa, Salmonella typhimurium LT2
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLVPFPGH

SEQ ID NO: 21588 - protein, 300 aa, Solanum tuberosum
RIGRLVARVALQRDDVELVAVNDPFISTDYMTYMFKYDSVHGQWKHHELKVKDEKTLLFGEKAVTVFGIRNPEDIPWAEAGADFVVESTGVFTDKDKAAAHLKGGAKKVAISAPSKDAPMFVVGVNENEYKPELDIVSNASCTTNCLAPLAKVINDRFGIVEGLMTTVHAMTATQKTVDRPSMKDWRGGRAASFNIIPSSTGAAKAVGKVLPSLNGKLTGMAFRVPTADVSVVDLTVRLEKEASYEDIQAAIKEESEGKLKGILGYTEDDVVSTDFVGDSRSSIFDAKAGLALSKNFVKL

SEQ ID NO: 21589 - protein, 184 aa, Amaranthus hypochondriacus
MASSMMSNAATAVAVAATSGGAQANMVAPFNGLKSIASFPVTRKSNDITSIASNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPTAFIRIIGFDNKRQVQCVSFIAYKPADSY

SEQ ID NO: 21590 - protein, 304 aa, Zea mays
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 21591 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTKYVENCKYPRDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 21592 - protein, 704 aa, Bacillus ohbensis
MKNLTVLLKTIPLALLLFILLSLPTAAQADVTNKVNYTRDVIYQIVTDRFSDGDPSNNPTGAIYSQDCSDLHKYCGGDWQGIIDKINDGYLTDLGITAIWISQPVENVYALHPSGYTSYHGYWARDYKRTNPFYGDFSDFDRLMDTAHSNGIKVIMDFTPNHSSPALETDPSYAENGAVYNDGVLIGNYSNDPNNLFHHNGGTDFSSYEDSIYRNLYDLADYDLNNTVMDQYLKESIKLWLDKGIDGIRVDAVKHMSEGWQTSLMSDIYAHEPVFTFGEWFLGSGEVDPQNHHFANESGMSLLDFQFGQTIRDVLMDGSSNWYDFNEMIASTEEDYDEVIDQVTFIDNHDMSRFSFEQSSNRHTDIALAVLLTSRGVPTIYYGTEQYLTGGNDPENRKPMSDFDRTTNSYQIISTLASLRQNNPALGYGNTSERWINSDVYIYERSFGDSVVLTAVNSGDTSYTINNLNTSLPQGQYTDELQQLLDGNEITVNSNGAVDSFQLSANGVSVWQITEEHASPLIGHVGPMMGKHGNTVTITGEGFGDNEGSVLFDSDFSDVLSWSDTKIEVSVPDVTAGHYDISVVNAGDSQSPTYDKFEVLTGDQVSIRFAVNNATTSLGTNLYMVGNVNELGNWDPDQAIGPMFNQVMYQYPTWYYDISVPAEENLEYKFIKKDSSGNVVWESGNNHTYTTPATGTDTVLVDWQ

SEQ ID NO: 21593 - protein, 240 aa, Oryza sativa (japonica cultivar-group)
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 21594 - protein, 314 aa, Sphagnum cuspidatum
VGINGFGRIGRLVARVISDRDDIELVAVNDPFISAEYMAYMFKFDSVHGQWKNHDIKAQNENSLLLGGKPVAVYGLKDPSEIPWGKHGADYIVESTGVFTDKAKAAAHLKGGAKKVVISAPSKDAPMFVMGVNEDKYTADLDIVSNASCTTNCLAPLAKVINDKFGIVEGLMTTVHSTTATQKTVDGPSHKDWRGGRAAGVNIIPSSTGAAKAVGKVLPELNGKLTGMAFRVPTIDVSVVDLTVRLEKPASYDAIKAAIRAEANGKMKGILGYTEEDVVSTDFITDSRSSIFDAKAGIALTDNFVKLVAWYDNE

SEQ ID NO: 21595 - protein, 548 aa, Mycobacterium tuberculosis CDC1551
MSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 21596 - protein, 302 aa, Shewanella oneidensis MR-1
MKQHQIRKAVIPVAGLGTRMLPATKAIPKEMLPVVDKPLIQYVVSEAIAAGIKEIVLVTHASKNSIENHFDTSFELEAQLERRVKRQLLEAVQSICPKDVTVISVRQSQAKGLGHAILCAKSVVGDAPFAVLLPDVIIDEASCDLKTDNLASMVSLFDETQVGQIMVEGVPHHLVNQYGIADVNGHDLQPGESEPLVELVEKPPVDEAPSNLAVVGRYVLPAAIWPLLAKTPAGAGDEIQLTDAIAMLMKEETVNAYYMQGKSHDCGNKQGYMRANVEYALRHSEIGEDFAHYLKTVVKGIK

SEQ ID NO: 21597 - protein, 486 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDIEKLQGKLSDDIPPSAPMAINCEYGSFDNEHVVLPRTKYDITIDEESPRPGQQTFEKMSSGYYLGEILRLALMDMYKQGFIFKNQDLSKFDKPFVMDTSYPARIEEDPFENLEDTDDLFQNEFGINTTVQERKLIRRLSELIGARAARLSVCGIAAICQKRGYKTGHIAADGSVYNRYPGFKEKAANALKDIYGWTQTSLDDYPIKIVPAEDGSGAGAAVIAALAQKRIAEGKSVGIIGA

SEQ ID NO: 21598 - protein, 471 aa, Sulfolobus solfataricus
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWTDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 21599 - protein, 370 aa, Glycine max
PRRPSVRLFACTASDHVNLTRPEPYGAGVGGLSRDIPETANVKLPCNTTHCQNSSKSKQARPITVGIVLLTIAVSAIGILTFTVYRRRKQKLGSTFDISEGCLSTDEAIGAYRKNGSPLVSLEYSNGWDPLADSRNFNGDSQEMFQSFRFNLEEMESATQYFSELNLLGKSNFSATYKGVLRDGSVVAVKSISKTSCKSDEAEFMKGLNMLTSLRSDNVVRLRGFCCSRGRGECFLIYDFVPNGNLSRFLDVKEGDGEVLEWSTRVSIVIAKGMAGIAKGIAYLHAYKANKPALVHQSISAEKVLIDQRYNPLLSDSGLTAARRRQKGGSNRVRVFESCSLHFVGSSLSIDRLRWQTKLTELLSLKFKVA

SEQ ID NO: 21600 - protein, 116 aa, Salmonella enterica
LAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPG

SEQ ID NO: 21601 - protein, 843 aa, Thermosynechococcus elongatus BP-1
MRVVVMAGGSGTRLRPLTCDLPKPMVPVVNRPIAEHILNLLRRHNLDDVVMTLHYLPDVVRDYFGDGNEFGVHLSYVVEEEQPLGTAGSVKNIVNLLTDPFLVVSGDSITDVDLTDALRFHQQHGAPVTLILARVPQPKEFGIVFTDSDGRVRRFLEKPSAAEVFTDTVNTGIYILNPTVMDYLNSGIERDFSRDLFPLLLQADVPMYGYITDAYWCDVGSLQTYQQVQQDALYGRVHLEIQGHEVQPQIWVGHNTPLPPTVQLQAPLVLGNNCRLGAGVTLGPGTVLGDNVMIGNGSRLRSVVAWNGCFIGDDSELEHCILARHVHVDRHVTLQEGVIIGSRCVVREEASLSQGVRIWPGKRIEAGAIVNQSLIWGTTGQRYLFGQRGVAGVANVDITPEFAVRLAAAYASILEPGTSVLVSRDQRNVSRMVSHALMSGLMSVGIHVLNLEAIALPIARFAAQTLSVSGGIHVRAHPDRADQLLIEFFDHKGINLSRAKERQIETAYFREEIRRALLTDVGVMTHPNNCVAAYAQGFEKWLNTQLFYGSPAKIVIDYAYAVSGVVLPQILSKFGCDAVVLNATLHPTPLNILERQRLLRELGQVVTALSASLGVQVSANGERLTLVDNAGQVFSDQELTALMTYLTLLTHPGGTVVVPVTTSSAVEAIARQQGGHIIRSRTNPTDLMEACQHQSGVVLGGSAETGFIFPQLHPGFDAMFTIATLIELLALIGKPLTVIRQELPRVHYYHRPIRCPWLAKGSLMRHLVETHPRNHLSLIDGVKIGEPNTDHWVLILPDASEPLVHLYVNSPDALWSQQMLQRYSRRIEAFARLEPLSDATIKM

SEQ ID NO: 21602 - protein, 670 aa, Arabidopsis thaliana
MAAATTTTTTSSSISFSTKPSPSSSKSPLPISRFSLPFSLNPNKSSSSSRRRGIKSSSPSSISAVLNTTTNVTTTPSPTKPTKPETFISRFAPDQPRKGADILVEALERQGVETVFAYPGGASMEIHQALTRSSSIRNVLPRHEQGGVFAAEGYARSSGKPGICIATSGPGATNLVSGLADALLDSVPLVAITGQVPRRMIGTDAFQETPIVEVTRSITKHNYLVMDVEDIPRIIEEAFFLATSGRPGPVLVDVPKDIQQQLAIPNWEQAMRLPGYMSRMPKPPEDSHLEQIVRLISESKKPVLYVGGGCLNSSDELGRFVELTGIPVASTLMGLGSYPCDDELSLHMLGMHGTVYANYAVEHSDLLLAFGVRFDDRVTGKLEAFASRAKIVHIDIDSAEIGKNKTPHVSVCGDVKLALQGMNKVLENRAEELKLDFGVWRNELNVQKQKFPLSFKTFGEAIPPQYAIKVLDELTDGKAIISTGVGQHQMWAAQFYNYKKPRQWLSSGGLGAMGFGLPAAIGASVANPDAIVVDIDGDGSFIMNVQELATIRVENLPVKVLLLNNQHLGMVMQWEDRFYKANRAHTFLGDPAQEDEIFPNMLLFAAACGIPAARVTKKADLREAIQTMLDTPGPYLLDVICPHQEHVLPMIPNGGTFNDVITEGDGRIKY

SEQ ID NO: 21603 - protein, 659 aa, Gossypium hirsutum
MAAATANSALPKLSTLTSSFKSSIPISKSSLPFSTTPQKPTPYRSFDVSCSLSHASSNPRNPATSVTPKNAPPHDFISRYADDEPRKGADILVEALVREGVKDVFAYPGGASMEIHQALTRSKIIRNVLPRHEQGGVFAAEGYARSSGIPGVCIATSGPGRTNLVSGLADAMLDSIPLVAITGQVPRRMIGTDAFQETPIVEVTRSITKHNYLVLDVDDIPRIVSEAFFLASSGRPGPVLIDVPKDIQQQLAVPKWNHSLRLPGYLSRLPKAPGEAHLEQIVRLVSESKKPVLYVGGGCLNSSEELKRFVELTGIPVASTLMGLGAFPISDDLSLQMLGMHGTVYANYAVDKSDLLLAFGVRFDDRVTGKLEAFASRAKIVHIDIDSAEIGKNKQPHVSVCSDVKLALQGINKILETKVAKLNLDYSEWRQELNEQKLKFPLSYKTFGEAIPPQYAIQVLDELTGGNAIISTGVGQHQMWAAQFYKYKKPRQWLTSGGLGAMGFGLPAAIGAAVANPEAVVVDIDGDGSFIMNVQELATIRVENLPVKILLLNNQHLGMVVQWEDRFYKANRAHTYLGDPSNESEIFPNMLKFAEACGIPAARVTKKEDLKAAMQKMLDTPGPYLLDVIVPHQEHVLPMIPSGGAFKDVITEGDGRTQY

SEQ ID NO: 21604 - protein, 134 aa, Oryza sativa
  unsure (1)..(134): unsure at all Xaa locations
SRHDAQKALTKHGQQLNSVLIIGVKQVDPWQRQYLNEKTNENFQVGATDPFPSQHVAPSSFTTRNALAPLPSNYMPNGIGNGSGRGASGAIASPTKSVLSKVMDXCIVPSLRSSGCHTGISPGRSGASVPGVSL

SEQ ID NO: 21605 - protein, 493 aa, Glycine max
  unsure (1)..(493): unsure at all Xaa locations
TQRFLSVQSWKTSRTSRNLRNSKPGSGIAHAVLTSDINEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYFASMDVYVFRTEIVILLLRWNRSSCNDFGSEIIPSAVNDHIERKLFYYGXVFIHKGKYSNSIILYDITXQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANTDGVQEADRAKEGFYIRSGITVTLKNATIKDGTVI

SEQ ID NO: 21606 - protein, 348 aa, Pichia stipitis
MSVPTTQKAVVFESNGGPLLYKDIPVPTPKPNEILINVKYSGVCHTDLHAWKGDWPLDTKLPLVGGHEGAGVVVGIGSNVTGWELGDYAGIKWLNGSCLNCEFCQHSDEPNCAKADLSGYTHDGSFQQYATADAVQAARLPKGTDLAQAAPILCAGITVYKALKTAQIQPGNWVCISGAGGGLGSLAIQYAKAMGFRVIAIDGGEEKGEFVKSLGAEAYVDFTVSKDIVKDIQTATDGGPHAAINVSVSEKAIAQSCQYVRSTGTVVLVGLPAGAKVVAPVFDAVVKSISIRGSYVGNRADSAEAIDFFTRGLIKCPIKVVGLSELPKVYELMEAGKVIGRYVVDTSK

SEQ ID NO: 21607 - protein, 265 aa, Hordeum vulgare subsp. vulgare
MGRGPVQLRRIENKINRQVTFSKRRSGLLKKAHEISVLCDAEVALIVFSTKGKLYEYSSQDSSMDVILERYQRYSFEERAVLDPSTGDQANWGDEYGSLKIKLDALQKSQRQLLGEQLDPLTTKELQQLEQQLDSSLKHIRSRKNQLLFESISELQKKEKSLKDQNGVLQKHLVETEKEKNNVLSNIHHREQLNEATNIHHQEQLSGATTSSPSPTPPTAQDSMAPPNIGPYQSRGGGDPEPQPSPAQANNSNLPPWMLRTIGNR

SEQ ID NO: 21608 - protein, 494 aa, Pseudomonas fluorescens PfO-1
MSALPDLSAAVADSDAEQLRQLGYTSNFNRSMSLWENFALGFTYLSPVVGVYTLFGLCLAAGGPPMFWAYLLVGCGQLLVCLIFGEVVSQFPISGGVYPWARRLVGKKWAWMVGWIYSIALCVTIAAVAVGAGPYLAAMLGFEPSNNTNIVIALVLTLFATLVNLSGTKVLARIAMFGFLCELVGAVIVGVYLLIFERHQPISVLFNTFDISVDGSYLPAFLTASLAGMFLYYGFEACGDVAEETPNPSAKIPVAMRMTIYIGGIAAMFACLALILAVPDMQAVINGTDKDPVTTILNNAFGPVGSKVVMGVVMISFISCVISLQAAASRLLYSYARDEMVIGSRLLKKISPTTQVPVAALFVSGVLPGLIIALGFFLQDAVATIVSFAAIGIYLAFQMIVLAALYARSKGWKPSGKFTLGAWGWPVNIGALVYGVGAIINMAWPRTPDAAWYINYAMVLSTAIVIGLGLVYMWIGKPYDHGKAPAGDAWKVGR

SEQ ID NO: 21609 - protein, 400 aa, Pseudomonas syringae pv. syringae
MNDALAQLQSYPFEKLRTLLNGVTPNASLRPIALSIGEPKHPSPAFVKTALAANLDKMSVYPATLGIPELRAAIADWCQQRFDVPKGWLDPARHILPVNGTREALFAFTQTVVRRDSNGLVISPNPFYKIYEGAAILAGATPHYLPCLESHGFNPDFDSVPADIWKRCQLLFLCSPGNPTGALVPLDALKKLISLADEHDFVIAADECYSEIYFDETSPPPGLLTACAELGRSDFKRCVVFHSLSKRSNLPGLRSGFVAGDADILKAFLLYRTYHGCAMPVHSQLASICAWKDEDHVRENRDLYREKFDAVLAILSPVMDVKKPDGSFYLWAKVPMDDAEFCRELFEQTHITVIPGSYLSREVDGVNPGAERIRMALVAPLAECVEAAERIRDFLLQRRL

SEQ ID NO: 21610 - protein, 96 aa, Tripsacum dactyloides
MGRRACCAKEGVKRGAWTSKEDDVLAAYVKAHGEGKWREVPQKASLRRCGKSCRLRWLNYLRPNIKRGNISYDEEDLIIRLHKLLGNRWSLIAGRL

SEQ ID NO: 21611 - protein, 401 aa, Pyrococcus furiosus DSM 3638
MAFLKVVSLEEAISIINSFRLEIGFEEVTLDKALGRIVAEDIYSPLDIPPFDRSTVDGYAVRAEDTFMASEANPVELKVIGEVHAGEQPSVKLSKGEAVYITTGSMMPENANAVIPFEDVEREGDIIRIYKPAYPGLGVMKKGTDIKKGQLLIRRGTKLTFKETALLSAAGFLKVKVFKKPKVAVISTGNEIVLPGEELRPGQIYDINGRAIVDAVNELGGEGIFVGIARDDRESLKKLILQALEVGDIIVISGGASGGIKDLTASVIEELGEVKVHGIAIQPGKPTIIGVINGKPVFGLPGYPTSCLTNFTLLVAPLLLRLLGREGKIKKVKAKIKHKVFSVKGRRQFLPVKLEGDVAVPILKGSGAVTSFVEADGFVEIPENVESLDEGEEVTVTLFSF

SEQ ID NO: 21612 - protein, 492 aa, Ricinus communis
MDPYRNRPSSGFNTPFWTTNSGAPVWNNNSSLTVGSRGPILLEDYHLIEKLANFDRERIPERVVHARGASAKGFFEVTHDVSHLTCADFLRAPGVQTPVIVRFSTVIHERGSPETLRDPRGFAVKFYTREGNFDLVGNNFPVFFIRDGMKFPDVVHAFKPNPKSHLQENWRIFDFLSHVPESLHMLTFLLDDLGIPQDYRHMEGSGVNTYTLINKAGKVHYVKFHWKPTCGVKCLLENEAIKVGGSNHSHATQDLYDSISAGNYPEWKLYIQIMDPAHEDKFDFDPLDVTKTWPEDILPLQPVGRLVLNKNIDNFFAENEQLAFCPGIVVPGVSYSEDKLLQTRIFSYSDTQRHRLGPNYLQLPVNAPKCAHHNNHHEGFMNFMHRDEEVNYFPSRCDPARNAESFPVPSAICSGKREKCVIEKENNFKQPGERYRSWAPDRQERFLNRLVGGLSDPRITHELRTIWISYWIQCDKSLGQKLATRLNVKPSI

SEQ ID NO: 21613 - protein, 95 aa, Triticum aestivum
  unsure (1)..(95): unsure at all Xaa locations
ILPQQPFVIGGSGGTASGKTTVCDMIIQQLHDHRVVLVNQDSFYRGLTAEESALAQDYNFDRXGAFDTEQLLECMGQRGGALPVNVPIYDFKNHR

SEQ ID NO: 21614 - protein, 422 aa, Zea mays
  unsure (1)..(422): unsure at all Xaa locations
MATKYAAAAADLVTGRPRKRARLGWDVASAAEAQIGTFCGQEVGDVASLLLSANPSDHTCSSLLPKGVARNASPPWREDDKDGHYVFAVGENLASRYKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCXGETLFQTHDNLEHLAMMDRVLGPLPRHMLERADXHAEKYVRKGGLNWPQAITTVESVRAVLKLPRLQNLVMQHVDHSAGDFIDLLKRLLAYEPSGRLTAQEALGHVFFTRYRQ

SEQ ID NO: 21615 - protein, 955 aa, Bacillus sp.
MINIRNTKVFLACIVMVTFSFLLSTSSVNDAYASQNSDQKPFSWDNATVYFAITDRFNDGNRGNNDSYGRPQKDAWGQNIGTFHGGDLQGLTDKLNEGYFTDLGINTIWISAPYEQIHGWVGGGSDGDFAHYAYHGYYALDYTTVDQNMGTVEEMREFVNTAHEQGIRVVLDVVMNHPGYNTIKDMNEYGFGNPGVSEDWTPGEGQTWHDVHNHIHYDDASPWSTWWGPWVRAGIGGYESCGNSETTMCLAGLPDFRTELTHSVGLPPLLETKWSQERREGYEDWIVPTASDLRRDLDIAPADYIVQWLAAWVEEFGIDGFRIDTAKHVELFRWQQLKDAANEALWSWREENPDAPGASWTDDFWMVGEVWGHGVGRSEYFDCGFDSIINFTFQGEHGNGPAYRLDTMEDTFSHYANQINMDASFNVLSYLSQHDTHLYPRERLVDGGTYLMLLPGGVKLFYGDETARPFGPTGSDPQQGTRSSMNWDSVHEDVLSHWQKMGQFRNNHLAIGAGAHKQIGTNPYTFSRTYVEDGVDDRVVVTVGATGETTIDVSSVFSDGQTVRDFYTGDSTVVENGKATFAAHQNGVILVETEGETIPSVSASPQGGEFSSEELEVTLSVLQAESGAYTIDGSDPKEKGTPFADGEVLTIGSDLAIDESLTLRLFAKNEAGEAERKYTFTKVPPYPHVFADPPGGSFSGDSLEVTLHVQNVGEGAYSVNGAAEQSFMDGDAITIGEGTEAGEEVTLQLKAENEFGSTEEMYTFIKSPGLTAYFKNPDTWGTPHIYYYETEPKVEEPSWGSAPEMELVENGWYKYTIEGAESARVLFKDAGANQWPGPGEEGFYRDQDGWFDGEWHSEKPVQANDITIYYKTSWTNPHIHYSLNQEAWTTLPGVPLNSSEYEGYAKITIETEEGSQLRAAFNNGRGQWDNNQGRDYVFHSGINTLADGVIVRGTP

SEQ ID NO: 21616 - protein, 208 aa, Michelia figo
  unsure (1)..(208): unsure at all Xaa locations
GLVKXAHEISVLCDAEVAVIVFSTKGKLYEYSTDSRMSRILERYERYSYAERELVLSGPESEGSWCLEYGKLKAKVESLQRNLRHFTGEDLDTLSLKELQQLEHQLDAALKHIRSRKNQIMFDSIAELQRKEKSLREQNNMLEKEIQEKEKAMAQQVQWEQQNQSQSSPSFLLPTLNIGTYHRGNEVEEEGARPPARTNSLMPSWMLC

SEQ ID NO: 21617 - protein, 339 aa, Achlya bisexualis
MAPVAIGINGFGRIGRLVCRAAFANPNATVVAINDPFMDLDYMVYLFKYDSTHGGYKGTVVAEDGNLVIDGHVVRVFSERNPNEIPWGEAGADYVCESTGVFTTTEKAGLHLQGGCKKVVISAPPKDSTPMYVMGVNHDKYDGSAHVVSNASCTTNCLAPLAKVIHDNFGIVEGLMTTVHAVTANQLTVDGPSRGGKDWRAGRGAGANVIPASTGAAKAVGKVLPELNGKLTGMAFRVPVPDVSVVDLTVRLEKGASLDTIKAAVKEASEGSMAGILGYTEDEVVSQDFVSDKRSSIFDANACIALNDNFVKLVSWYDNEWGYSNRLVDLVVHMATIDN

SEQ ID NO: 21618 - protein, 472 aa, Pseudomonas fluorescens PfO-1
MWTIRHSYIDGAFVPVQGRETIECINPATESVIGTVTLANREDARQAIAAAQRAQVTMGRTSKAERIDMLRRLQAAVLESTEEIRDTAIDEYGAPLARAQWVSQYASQSFANTAQVLENHQLVRPVGRATVVMEPVGVSALFAPWNSTAGTVCSKLAAAIAGGCASVIKPSELSPLQTQVLALALHRAELPNGVINIVLGRGSDVGDEISTSPHIAKISFTGSTATGKLIARAGIETMKRVSLSLTGKSASIVLDDADLETAIPMALNAAFMNNGQACVAGTRLLVPRGCLPQVIERVKTLVDATVVGDPRDPATAIGPLVNQAQFDRVQGFIRRGLEQGARLIVGGEGRPHGLSKGYFVKPTVFADVSNDMDIAREEIFGPVLSIIAYDDEEDAIRLANASVYGLQAYVFTREVERGRRIAARLEAGSVLINRIAPELLAPFGGVKQSGIGREFGVSGLEAFLEAKSIVED

SEQ ID NO: 21619 - protein, 288 aa, Rhodobacter sphaeroides
MARPRISFEFFPPQTLEASFRLWETAQMLAPLKPDFVSVTYGAGGTTRKLTHDAVETIHTHYKLNVAAHLTCVDATKAETLEIAASYAEAGVTEIVALRGDAPKGVDRFTPHPEGFASSVELVEALAATGRFKLRVGAYPEPHPDAADTLADVRWLKRKIEAGATSAITQFFFEAETFLRFRDLCAKEGITAPIIPGILPIENWSGVKKFAARCGAQVPGWLDDAFDHARRDGREELFSVALCTELCDRLLSEGVEDLHFYTLNRPTLTREVCHALGILPEVALQNVA

SEQ ID NO: 21620 - protein, 476 aa, Onikusa pristoides
SQRYESGVIPYAKMGYWDPDYAVKETDVLALFRVTPQPGVDAVEASAAVAGESSTATWTVVWTDLLTACDLYRAKAYKVELVPNTTDQYFAFISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLEVDLPQGIFFEQDWASLRKVTPVASGGIHCGQMHQLLDYLGDDVVLQFGGGTIGHPDGIQAGATANRVALEAIVIARNEGRDYVAEGPQILRDAAKTCGPLQTALDLWKDISFNYTSTDTADFVETPTANV

SEQ ID NO: 21621 - protein, 183 aa, Hevea brasiliensis
MASSMLSTAAVACINRASPAQASMVAPFTGLKSTSAFPTTRKTTTDITSIASNGGRVQCMQVWPPRGKKFYETLSYLPPLTREQLAKEVEYLLRKGWVPCLEFELEHGTVYREYHRSPGYYDGRYWTMWKLPMFGCTDAVQVLQELDEMIKAYPDCYGRIIGFDNVRQVQCISFLAYKPKGAE

SEQ ID NO: 21622 - protein, 350 aa, Helicobacter pylori J99
MRVPSKGFAIFSKDGHFKPHDFSRHAVGPKDVLIDILYAGICHSDIHSAYSEWKEGIYPMVPGHEIAGVIKEVGKEVKKFKVGDVVGVGCFVNSCKTCKPCKEHQEQFCANHKTVFTYDCLDYFHDNEPHMGGYSNNIVVDENYVISVDKNAPLEKVAPLLCAGITTYSPLKFSKVTKGTKVGVAGFGGLGSMAVKYAVAMGAEVSVFARNDHKKQDALNMGVKHFYTDPKQCKEELDFIISTIPTHYDLKDYLKLLTYSGELALVGLPPVEVAPALNVFEFIHLGNRKVYGSLIGGIKETQEMMDFSIKHNIYPEVDLILGKDIDTAYHNLTHGKAKFRYVIDMKKSFD

SEQ ID NO: 21623 - protein, 455 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAESDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKLHFRTQQGIENLTDEEAAEIIATGRDSSQRDLFEAIEKGDYPKWTMYIQVMTEEQAKNHKDNPFDLTKVWYHDEYPLIEVGEFELNRNPDNYFMDVEQVAFASTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEGAKERILQIQQMQWKA

SEQ ID NO: 21624 - protein, 666 aa, Nitrosomonas europaea ATCC 19718
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVV

SEQ ID NO: 21625 - protein, 514 aa, Staphylococcus epidermidis ATCC 12228
MVVPFKNEPGIDFSVQTNVERFNEELRKVKAQLGQDIPLVINGEKLTKTDTFNSVNPANTSQLIAKVSKATQDDIEKAFESANHAYQSWKKWSHKDRAELLLRVAAIIRRRKEEISAIMVYEAGKPWDEAVGDAAEGIDFIEYYARSMMELADGKPVLDREGEHNRYFYKPIGTGVTIPPWNFPFAIMAGTTLAPVVAGNTVLLKPAEDTVLTAYKLMEILEEAGLPQGVVNFVPGDPKEIGDYLVDHKDTHFVTFTGSRATGTRIYERSAVVQEGQQFLKRVIAEMGGKDAIVVDNNVDTDLAAEAIVTSAFGFSGQKCSACSRAIVHQDVHDEILEKAIQLTQKLTLGNTEENTFMGPVINQKQFDKIKNYIEIGKKEGKLETGGGTDDSTGYFIEPTIFSGLQSADRIMQEEIFGPVVGFIKVKDFDEAIEVANDTDYGLTGAVITNHREHWIKAVNEFDVGNLYLNRGCTAAVVGYHPFGGFKMSGTDAKTGSPDYLLNFLEQKVVSEMF

SEQ ID NO: 21626 - protein, 663 aa, ASPERGILLUS NIDULANS FGSC A4
MNDIGLLHAPHGPGQDPLQNMDAHEKDAFDALIRPDDSYTADGTYWADLSLFRKIKFVSSYDAGEAKRELSDIWKMFKADPLSPMSYYFQNMVLPGAGLGLEGYVLFSIGNLKPLFQAAFASCWDHDYEGEHICNAQWLNAIEYLEICGIIVGQILVGIVGDWLGRRWGLIQDAAIMLLGLVMLTAAWGVTQNGWVICYAWSLFIYGIGVGGEYPMTATSGMENAVGSGKVSTKEDRLHRGRKVTSAFLMQGWGQFFNQVLLIILLLCFHHGSGNPPYSTVSAQWTYRISFAIPAVGTLWLVYYRTYHMKAASKQLQAAKKKASVTGYDVNSLKLTFQHFGFRLVATTGAWFANDVFFYGNKLFQSEFIKVISPASTSIMPTWLWNLVNVGVSLCGYYLASFLIDNKLYGRKWMQIIGFLMDFILFIVPAFHFDYYTSPEHIKEFQAMYFLSSFFNQFGPNSVTFLVAAEVFPTPIRATAHGMSAAAGKLGALLASVLYNYIDTQTKFYVVPWFGLAGLVLTFFFLPDTTGLDLKEQERRWKYIREGREQDYHGPAVHPKHLSLWERVRGTGKYYDAELDYKQKVEEYRAEWEAAMSARISEKDKDGEEDADEELLSGHVNNYFYRTSPMFRGMEAKPGKGDDFALPPAARSDDSTQNSVQEK

SEQ ID NO: 21627 - protein, 79 aa, Oryza sativa
QKLGANAILAVSLAICKAGAIIKKIPLYQHIANLAGNKQLVLPVPAFNVINGGSHAGNKLAMQEFMILPTGAASFKEAM

SEQ ID NO: 21628 - protein, 408 aa, Magnetospirillum magnetotacticum
MLGAAFLAVTGGEAMYADLGHFGARAIRVAWFALVLPALAIHYFGQGAILLVDPSAAENPFYRLAPAFAHYPLIALATLAAVIASQAVISGVFSLTQQAIQLGFLPPLHIVHTAPDERGQIYVPTVNWLLAAATLSAVLIFRSSDALAGAYGIAVSLLMAITTLLAGLVARKWGYGLIPVLAVNGFFLLIDLIFLSANSVKLFEGGWFPLLLAGAVAFLMLTWRKGNACLEEARIALRQPEARFLEGLRDTPPTTLPGSAAFLSSALEGIPLPMMRFVERLGALHARVLIVTALFEETPTVPPDKRARVTEITPDIRRVVLRYGFMQSASIPEGLACAVQAGLLPAAFTEDLTVFVGHETIIPVSDRRGMSDWREAVFAVMQNNAERTGAHFCVPTRQVIEIGTEIEI

SEQ ID NO: 21629 - protein, 320 aa, Diospyros kaki
MEAFPVINMEILNGEGREAAMEKLRNACENWGFFEVVNHGISHELMDSVERLTKEHYKKFMEQRFKEMVASKGLEVVQSEINDLDWESTFFLRHLPSSNLSELPDLEDDYKKAMKEFAEDLEKLAEQLLDYLCENLGLEKGYLKKAFYGSKGPTFGTKVSNYPPCPRPELIKGLRAHTDAGGIILLFQDDKVSGLQLLKDGQWIDVPPLKHSIVINIGDQLEVITNGKYKSVMHRVIAQTDGNRMSIASFYNPGSDAVIYPAPALVEKEADHEQKQVYPKFVFEDYMKLYAGLKFQAKEPRFEAMKAMETPLNLGPIATV

SEQ ID NO: 21630 - protein, 98 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVK

SEQ ID NO: 21631 - protein, 197 aa, Yersinia kristensenii
SSIGGWKGINESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATRFNTMTKKADEIQIYKYVVHNVAHA

SEQ ID NO: 21632 - protein, 518 aa, Raphanus sativus
MEDIQEEENGTDVEVLGLSLTMEKVAAAKQYIENHYKAQNKNIQERKERRWILERKLASSGVPKEEQINMIKDLERKETEFMRLKRNKISVDDFELLTIIGRGAFGEVRLCREKKSGNIYAMKKLKKSEMVMKGQVEHVRAERNLLAEVASHYIVKLYYSFQDAEYLYLIMEYLPGGDMMTLLMREDTLREDVARFYIAQSVLAIESIHRYNYIHRDIKPDNLLLDKDGHMKLSDFGLCKPLDCRTLPSIQENRATDDEAVSEPMDVDRAFPDTDNKRSWRSPQEQLQHWQMNRRTLAFSTVGTPDYIAPEVLLKKGYGMECDWWSLGAIMYEMLVGYPPFYADDPLSTCRKIVNWRNHLQFPEDAKLSREAKDLICRLLCNVDHRLGTGGGAQQIKVHPWFKDVVWEKLYEMEAAYKPEVNDELDTQNFMKFDEVNSPATERTKSGTSRKNLAPKDLSFVGYTYKNFDAVKGLRHSLEMARTMSLDRSPAEVMPVERISGEAAEAQMVSSMDDPMVI

SEQ ID NO: 21633 - protein, 224 aa, Triticum aestivum
IPGNVFWPVFLLANLAALIASRTMTIAIFQCLKQSISLGCFPRLKIVHTSRKFMAKIYIPVVNWFLLASCLGFILLFRSTSDVGNAYAIAELGVMIMATVYVTLIMLLIWETNIIKVVSFLITFLSLELIFFSSALSSVGDGGWALLVFASGLVMIMFIWNYGTKLKYDSELKQKLSRDLMRKLGPNLGTMRAPGLGLVYSEFVTGLPFWAFLTPPASPKRRGL

SEQ ID NO: 21634 - protein, 902 aa, Saccharomyces cerevisiae
MPPASTSTTNDMITEEPTSPHQIPRLTRRLTGFLPQEIKSIDTMIPLKSRALWNKHQVKKFNKAEDFQDRFIDHVETTLARSLYNCDDMAAYEAASMSIRDNLVIDWNKTQQKFTTRDPKRVYYLSLEFLMGRALDNALINMKIEDPEDPAASKGKPREMIKGALDDLGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDFAKFNNGDYKNSVAQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPVGLFGHLLPRHLEIIYDINWFFLQDVAKKFPKDVDLLSRISIIEENSPERQIRMAFLAIVGSHKVNGVAELHSELIKTTIFKDFVKFYGPSKFVNVTNGITPRRWLKQANPSLAKLISETLNDPTEEYLLDMAKLTQLGKYVEDKEFLKKWNQVKLNNKIRLVDLIKKENDGVDIINREYLDDTLFDMQVKRIHEYKRQQLNVFGIIYRYLAMKNMLKNGASIEEVAKKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSVANVGFFSSDRCIEEYSDTIWNVEPVT

SEQ ID NO: 21635 - protein, 584 aa, Clostridium thermocellum ATCC 27405
MNTTMIVDTLWVVFAALLVFFMNLGFAAVESGFARSKNTVNILSKNFIVFAVSSLGFMLLGWGLMFGGDNPIIGTKELFILGGSDLGFYKDTLTSTVPFWGKFFFQLVFCGTAATIVSGAVAERIKYISFIVFSFILTLFIYPVVGHWIWGGGWLANLGFMDFAGDTVVHSVGGWAALTGAIILGPRHGKYDKDGKPKAIPGHSLALAVIGLFVLWLGWFGFNPGSTMSFQNPEDVVHIIVTTNTAAIAAILTATATSWIFIGKPDLGMTINGCLAGLVGITGSCAYVSVGSSLIIGAIAGIIVVFSVIFFDRIKVDDPVGATSVHLVCGVFGTLCVGLFAQEGVTSLSTVNGLFFGGGFSLLGAEIIGIIAVGAFVVASSALVWFILKKTIGIRVSLEEEIQGLDIGEHGNSAYPDFAIVAPITASGNGNGDSIVAISQVETIKPSSVKVTPEAAIPVVNRSHPGAKMTKVTVITNQDKYTQLQNALDKIGITGLTVTNVLGYGMQKGHTEYFRGLPVKTRLLPKVQVDIVVCKIPVETVVDTVKKALYTGNMGDGKIFIYDVENVIKIRTGEEGYDALQDEE

SEQ ID NO: 21636 - protein, 144 aa, Allium sativum
QVEYAMEAIGNAGSAIGILAKDGVVLVGEKKVTSKLLQTSKSTEKMYKIDDHLACAVAGIMSDANILINTARVQAQRYAFSYQEPMPVEQLVQSLCDTKQGYTQFGGLRPFGVSFLFAGWDKNYGFQLYMSDPSAIMVDGKPPP

SEQ ID NO: 21637 - protein, 308 aa, Arabidopsis thaliana
MGDVYFNHFAQQLQMSDQEKGEMSRHSHPHSINEESESSTLERVAAESLTNKVLDRGLMEYGCPHYRRRCCIRAPCCNEIFGCHHCHYEAKNNINVDQKQRHDIPRHQVEQVICLLCGTEQEVGQICIHCGVCMGKYFCKVCKLYDDDTSKKQYHCDGCGICRIGGRENFFHCYKCGCCYSILLKNGHPCVEGAMHHDCPICFEFLFESRNDVTVLPCGHTIHQKCLEEMRDHYQYACPLCSKSVCDMSKVWEKFDMEIAATPMPEPYQNRMVQILCNDCGKKAEVQYHVVAQKCPNCKSYNTRQTRG

SEQ ID NO: 21638 - protein, 170 aa, Zea mays
MAPTVMMASSATAVAPFQGLKSAASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 21639 - protein, 247 aa, Datisca glomerata
MALEALNSPTTATPVFHYDDPSLNYLEPWTKRKRSKRTRLDSPHTEEEYLAFCLIMLARGRVASANRRDSQSSIQIQPEATTSATKVSYKCSVCDKAFSSYQALGGHKASHRKLAGGEDQSTSFATTNSATVTTTTASGGGGRSHECSICHKSFPTGQALGGHKRCHYEGSIGGNSIHHHNNTTNSGSNGGMSMTSEVGSTHTVSHSHRDFDLNIPALPEFRSNFFISGDDEVESPHPAKKPRILMK

SEQ ID NO: 21640 - protein, 362 aa, Pseudomonas aeruginosa PAO1
MKPLLHAFAPGVMALMLLLPQAAQAKEVAPQQKLSNVVILATGGTIAGAGASAANSATYTAAKVPVDQLLASVPQLKDIANVRGEQVFQIASESFTNENLLELGKTVAKLADSDDVDGIVITHGTDTLEETAYFLTLVEHTEKPIVVVGSMRPGTAMSADGMLNLYNAVAVAGDKSARGKGVLITMNDEILSGRDASKMVNIKTEAFKSPWGPLGMVVEGKSYWFRAPVKRHTVNSEFDIKQISALAPVEIAYSYGNVSDTAYKALAQAGAKAIIHAGTGNGSVPARVVPTLQELRKQGVQIIRSSHVNAGGFVLRNAEQPDDKNDWIVAHDLNPQKARILAAVAMTKTQDSKELQRIFWEY

SEQ ID NO: 21641 - protein, 314 aa, Agrobacterium tumefaciens str. C58
MLFISEEESATLVTHDLAFTAAWEALIAACDEATASFPVVLGHGSSTNNRFSVKAAATVELAGLKVGSYWPGNRDLGLSRHNSLILLFDQDTGRIGTAMEAGTVNAYRTAAADAVAADQLARRDAETLAIFGAGHQARYECMALARVRSLRRVMIVARNGEQAEEMRSALRQHGLNAEVAAPQNACAEADIIVTATSSRAPLFEADWVRPGTHVASMGSDARGKQELPPALFARGDLFCDLPEQARSIGEFQHAAPDLEVTALGDVLAGRRPGRSSDSAITIFDSSGLSLQDLYIARHLLAKRGAHETPLSANN

SEQ ID NO: 21642 - protein, 110 aa, Zea mays
  unsure (1)..(110): unsure at all Xaa locations
SAQHLGDLYRDFVKDFPIVSIEDPFDQDDWSSWASLQSSVDIQIVGVMVSHRSGETEDNFIADLAVGLASGXIKTGAPCRSERLAKYNQLLRIEEELGNVRYAGEAFRSP

SEQ ID NO: 21643 - protein, 385 aa, Zea mays
MAAGASDYSFAAEYVGPPLPYTLPRAIPLDLSRIPLAALSSSPPASPSASSSPLPVVRPLTPSSLCNAIHAHAHPAPRSAVPAPAGGGAVVDSPTSVIENHHAAAHHSAELPSSPSDDEAAGDGDGDGGSEALPLKPRHHPPVVTFAETSGSLLQSSDDEDEYEEEDDDDDDADAGETRPRAAAGQSSGSLSPAHWRGGRTRGCYRCGKGGGFWGRDKESCLACGARYCVGCVLRAMGSMPEGRKCLECIGRPVAESRRDALGRGSRVLRRLLSAAEVELVMRSERECAANQLRAEDVYVNGSKLSPEELVVLQGCPCPPSRLRPGFYWYDKVSGFWGKEGHKPHCIITANLNVGGSLDQKASNGNTGILINGREITKSELQMLK

SEQ ID NO: 21644 - protein, 378 aa, Schizosaccharomyces pombe
MDSIGDNVTEMDAFVRDLTMKPYAELEKRKAELHAQKLKLVQKRQQLLRDNYNVLVDYARNQDAFYQLLENSRHDFKELVLHTNQLYEPVKRSQNFLTSISEHYRDAKLMHQVQPQLSSILELPELMNACIERNYFSETLEFQALAYRLKDRFGTNSIIQELITQVETLVVKLTEKLILQLQKPLKLYSLIKVVTYLRVTAKLSEAQLKYVFLYFSWKQLQTSLRNLVPLLDYNNPELYLRRYIQVIRDRAFSLLFQYQSVFGESSNDRLNAAGTVDIPNSTSTSASPFEMDPEGFNNFGQNILSSFVRKLQLEICYVLQKFMPNVKDSTSKFSLLLQLYYCNQSLTKVGTDISIPLSKILGSEWLEMIHSQSSEKQA

SEQ ID NO: 21645 - protein, 294 aa, Hordeum vulgare subsp. vulgare
MKATAGALLAVVATVLLRGIAAAPPRKPVDVPFEKNYVPTWAEDHIHYVNGGREVQLSLDKTTGTGFQTRGSYLFGHFSMHIKLVGGDSAGTVTAFYLSSQNSEHDEIDFEFLGNRTGQPYILQTNVFSGGKGDREQRIYLWFDPTKDYHSYSVLWNLYMIAFFVDDTPIRVFKNSKDLGVRYPFDQPMKLYSSLWNADDWATRGGREKTDWSKAPFVASYRGFHVDGCEASAEAKLCATQGARWWDQPEFQDLDAAQYRRLAWVRKEHTIYNYCTDRERYAAMSPECKRDRDV

SEQ ID NO: 21646 - protein, 432 aa, Nicotiana tabacum
MDCSIRIQNPLSTTTITSALFSNKKSANFRVFTVGCSSKILSSDGAPSGLVERPWKVADARLVLEDGSIWKAKSFGASGTQVGEVVFNTSLTGYQEILTDPSYAGQFVLMTNPHIGNTGVNFGDEESMQCFLAGLVIRSLSISTSNWRCKETLDEYLAKRNIMGIYDVDTRAITRRLRQDGSLIGVLSTENSKTDEELLEMSRTWDIVGVDLISGVSCKSPYEWVDRTASDWDFNDNGRNKETFNVVAYDFGIKHNILRRLASYGCKITVVPSTWPASETLKMKPDGVLFSNGPGDPSAVPYAVEAVKELIGKIPVFGICMGHQLLGQALGGKTFKMKFGHHGGNHPVRNLRNGCVEISAQNHNYAVDPESLPEGVEVTHVNLNDGSCAGLASFKMKLMSLQYHPEASPGPHDSDPVFGEFIQLMKQEKVKA

SEQ ID NO: 21647 - protein, 193 aa, Burkholderia fungorum
MSKQRAKLVVGNWKMHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQRHASC

SEQ ID NO: 21648 - protein, 418 aa, Colletotrichum lagenarium
MGDLQGRKVFKVFNQDFIVDERYTVTKELGQGAYGIVCAAVNNQTQEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPQLFAQANPDALDLLDRMLAFDPSSRISVEQALEHPYLHIWHDASDEPDCPTTFNFDFEVVEDVGDMRKMILEEVYRFRQLVRTVPGSTQAGAQAAGQAGAGQVPIPSGNPGWTSSDPRPQEYVGQGGGLEADLAGGLDHRR

SEQ ID NO: 21649 - protein, 549 aa, Oryza sativa
MDSARSWFTKLQTREKSIGKKKELPPNGKEGTDEAPSSATKQRVAAAKQYIEKHYKEQMKNLQDRKERRCSLEKKLADANVSEEEQHNIVKQFEKKETEYMRMQRHKMSVDDFDLLTMIGKGAFGEVRVCREKNTGNVYAMKKLRKSEMLRRGQVEHVKAERNLLAEVDHHCIVKLYCSFQDSEYLYLIMEYLPGGDMMTLLMRKDTLTEDEARFYVGETVLAIEAIHRHNYIHRDIKPDNLLLDRHGHLRLSDFGLCKPLDYSNFPDLNEKDVTSTKPQSTNGDGRQQSMPKRTQQEQLEHWQKNRRTLAYSTVGTPDYIAPEVLLKKGYGMECDWWSLGAIMYEMLVGYPPFYSDEPMTTCRKIVNWRTHLKFPEEARLMTDAKDLISKLLCNVDQRLGTKGAEEIKEHSWFSGVEWDKLYEIEAAYQPQVTDELDTQNFEKFEESSDNIQCSAKAGPWRKMLSSKDLNFVGYTYKNFELVNDPEVLGMAELKKKEKAKRPSAKSLFDSSPAAEEQPAPAPAPAENAEGSPRSTEPAMPRSLSAPST

SEQ ID NO: 21650 - protein, 307 aa, Malus x domestica
MGEGEEDCRTIPAIDLKKFPDAEEYRKLREASETWGCFRLVNHMIPPALMSEMKSVVRSLLDLPMEIKKQNKDVIAGSGYMAPSKVNPLYEALGLYDLGSGQAVDSFCSRLNASSYQRDVIEKYAQAVYEQIVDIGKRLAESLGLADSDYLKGWPCQFRINKYNFTPESVGSSGVQLHTDSGFLTILQDDEDVGGLEVMDKSGAFVAVDPCPGTLLVNLGDVAKAWSNGRLCNVKHRVQCRDATIRISVATFLLGPKEEAVVDAPAEFVDPEHPRLYVPFTYEDYRKLRLSTKLQAGEALALMPSPS

SEQ ID NO: 21651 - protein, 383 aa, Zea mays
  unsure (1)..(383): unsure at all Xaa locations
MASEVEDEAATPLLANGAADVRRRRDQAKAILSTQAVRIATKAEQHERFIFKVTHLLGVLGFGGFCYLLGSSKLLQHXIFGPQDVPYVYCLFYVIFVPLRWIYYRYKKWHYYLLDFCYYANTFLLVMILFYPEDEKLFMVCFSFAEGPLAWALIVWRCSLVFSSFDKLVSVLIHLLPGIVLFTIRWWNPQTFAAMHPEGRDARVTWPYVEDKSYLWTWLFFVPLAAYTLWQLMYFLIVNVLRRQRLLRDPEVMTSYRELSKKAQKANNIWWRLSGLLGDRNRQVMYILLQALFTVATMALTVPIFLSYRMHVVFLILKVCASTWNGGSFILEVMPRQXVVQKQLKKLDMKPMEQGSSTQGAPGGDGGTLGNHHQHTSEEHIQE

SEQ ID NO: 21652 - protein, 541 aa, Oryza sativa
  unsure (1)..(541): unsure at all Xaa locations
MDAAAVMQKQLRRLRTLGRGASGAVVWLASDDASGELLAVKSAAGEGGAEQLRREGRVMSGLCSPHIVPCLGSRAAAGGEYQLFLEFAPGGSLADEAARSGGRLAERAISAYAADVARALAYLHGNSLVHGDVKARNIMVGADGRAKLADFGCARRTDSERPIGGTPAFMAPEVARGEEQGPAADVWALGCTIIEMATGRVPWSDMDDVFSAVHRIGXSDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTVRARGFIEYDRQLSVRVRGDMPLCPVDCHRSDTVKFGCHCNGNRVINFESAQICLLLPFILQSRAHRLHSVELPRIVSCSPTLEDCIVKCPIGFAATAGLPLGSPQPDYSHTCDTYVSYPSCVVHASMGTIGDGQREESERHREDMEDQELRICSGITTWKF

SEQ ID NO: 21653 - protein, 337 aa, Lactococcus lactis
MVVKVGINGFGRIGRLALRRIQEVEGVEVAHINDLTDPAMLAHLLKYDTTQGRFKGTVEVKEDGFDVNGKFVKVTAERNPEDIQWADSGVEIVLEATGFFATKEKAEKHLHPGGAKKVLITAPGGNDVKTVVFNTNHTILDGSETVISAGSCTTNSLAPMADALNKNFGVKGGTMTTVHSYTGDQMTLDGPHRGGDFRRARAAAENIVPASSGAAKAIGLVLPELSGLMKGHAQRVSTPTGSITELVTVLEKHVTVDEINEAMKAAADESFGYNVDEIVSSDIIGMAYGSLFDATLTEVTDLKDGGQLVKTAAWYDNEMSFTAQLIRTLEYFAKIAK

SEQ ID NO: 21654 - protein, 241 aa, Zea mays
MSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTVERTVPLANHPDPNNAKSCHAGCWATGVGAALRAEGEAVVDRGAWRAGAEHVGQGRTDSPMPRAAEPPRG

SEQ ID NO: 21655 - protein, 366 aa, Leptospira interrogans serovar lai str. 56601
MLEYVLANRIQGLDTSAIRKAFELAGTLKNPINLSIGQPHFPCPSNIIEAGSKALKEGKTAYTLTGGIPELKSALSEKYKNENEISYAKPERILVTSGISSAFLLLFNALLNEGDECLVITPHFLMYPAYIKIYGGKMNSIHESFEPEELKEFANKKLKIIIYSSPSNPTGKILSKKQLEALAELAEKTGAYLISDEIYEKFDYDKKFISVGSFYEKAITLSGFSKTYSMTGLRLASILAPESITKTLTTLQQYTLVCAPSITQWMGIEALKTDMSPYIADYKEKRDFVFESLKDHYEITKSEGAFYFFIKIKEKDEDFILKAVKEKELILVPGYIFTSSKNYIRISFASEWENLKRGISALVDLA

SEQ ID NO: 21656 - protein, 758 aa, Streptomyces avermitilis MA-4680
MSEANPLKRAARKITNSLQDNGATPEEGIPGRPGPESPSVAEPTEPRDPLPPKPDQSGPDTVSPTGQPTGADQARMAQSGSYLTTAQSTRLYDTDHSLKAGPRGPVLLQDHHLREKVMHFDHERIPERVVHARGAAAHGVFQSYGTAASVTKAAFLSEDKETPVFVRFSTVLGSRGSSDTVRDTRGFATKFYTSEGVFDLVGNNIPVFFIQDAIKFPDVIHAGKPHPDREIPQAQSAHDTFWDFVTLHTEATHHTLWNMSDRGIPRSYRMMEGFGVHTFRLVNAEGATTLVKFHWKPKLGVHSLVWEEAQITNGVDPDFHRRDLADAIEAGAHPQWELGIQTFPDTPDQTFEGIDLLDPTNLVPEELAPVQPVGLLTLMRNPSNFFAETEQVAFHVGHLVPGVDVTDDPLLAGRLFSYLDTQITRLGGPNFPQLPINRPHAPVNDMLRDGMHQTAVHRGVAPYRPNSLDGGCPFLAGADTGAFVETPVRVPEAAKVREAPESFADHFSQPRRFWLSMSPIEREHIIAAYTFELGKCYEQAVKERALQVLANIDPNLCAEVATGLGLPAPQPTVPLAEVEASPALSQVGGTWPTDGRVIGIVIGPDGDLRGVSAVREAVLDASMVPLVVAPAGGVFGSGEGMVTVQRTYATARSVEFDAILLAGTPGVGGDAYGARDAKAFPAPAQQATGDPRVGLLVSEAFRHGKAVGAWAGGEAFLEASGVPLDAPGVVVGDSGTGALAQLTGLLGKHRAWDRFRAV

SEQ ID NO: 21657 - protein, 369 aa, Oryza sativa
MDAQYNPRTVEEVFRDFKGRRAGLVRALTADVEDFFRQCDPEKENLCLYGFPNEHWEVNLPAEEVPPELPEPALGINFARDGMQEKDWLSMVAVHSDAWLLSVAFYFGARFGFDKNDRKRLFGMINDLPTIFEVVSGKSKAKPPSANNHSNSKSKSSNKTKSSEPRAKQPKPQPQPPVKNEGREEEGGPDDEEGGGGGGGGGREEEHGETLCGACGESYGADEFWICCDICEKWFHGKCVKITPAKAEHIKQYKCPSCSGGNGGGGGVSGNGKQLKICSTKREAIISQYLVRDERSKNTSTHARSPLISDNPYEVISDIRIMLAEQYTTNAREDDFDAKPNDKDNQGEGNVAWGGINKELYSLQVTIQN

SEQ ID NO: 21658 - protein, 580 aa, Schizosaccharomyces pombe
MEPEYVSFSDKDTKSILNESKSSLKDVKPSLEEKSYITPGLVDDVEPKGKNFVVRFFDDFKPAKATGEDGTALKRSLKSRHMQMISIGGAIGTGLYVGSGSSLADGGPASVIINYSLIGIMMFFIVYALGEMAVAYPVAGGFNTYATRFIDPAWGFAVSWNYFINYFVTFPLELTTCAITFRYWTDINSAAWISIFLVVIIIVNLFGVRAYGEVEFILSTVKVVATFGFIILAIIINCGGVPTDHRGYIGGSIIKHKPFRHGFKGFCSVFTTAAFSFSGTEVIGLAAAEVDNPQKALPHAVKQVFWRIAIFYVVSLILIGLLISPDDPNLMGNGSTSVSPFVLAIKEANIKGLPSVFNAVIIISVVSVTNSSTYTAGRTLHGMANLKQAPSFFKYTDRLGRPLLAMIVVLLFGFFAYINEADKNGNDVSDTVFNWLLALSGLSNFFTWGSICLCHIIFRLAFKKQGHSLKELGFVSPMGIWGSCIGLFFNILCLMAQFYVSLFPIGGKPNANDFFQGYLAAPVTLAFFIGYKIYDRSHIPSLDKLDITTGLKTYENLDEEEDEPTTASKRIFKKISSVFC

SEQ ID NO: 21659 - protein, 473 aa, Xanthomonas citri
MQHPRAFACLGDRVTDLLVRTSVEEGDAHVCFLRAHKRCRAVRAGQSIECGGVEQEHEIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 21660 - protein, 424 aa, Oryza sativa
MEGAAPLLAARGEEEVVEGRRRGGGGGATSAQTLGNVVVSIVGTGVLGLPYAFRTAGWVAGSLGVAAAGCATLYCMLLLVDCRDKLEEKESEETYHGHYTYGDLGEKCFGTIGRCLTEILILVSQAGGSVAYLIFIGQNLHSVFSQLMSPAAFIFAILLPMQIALSFIRSLSSLSPFSIFADVCNVLAMAIVIKEDLQLFDHPFANRSAFNGLWAIPFTFGVAVFCFEGFSMTLALESSMAERRKFRWVLSQAVVGIIIVYACFGVCGYLAYGEATKDIITLNLPNSWSSAAVKVGLCIALVFTFPVMMHPIHEIVEERFQSSGCFPKLSHKVRGAEWVGLHSSRIVMVTILSVVASFIPAFGSFISFVGSTVCALLSFVLPTIFHLSIVGSSMSPWRHWVDYGFLLFGLGFAGYGLITALFSH

SEQ ID NO: 21661 - protein, 270 aa, Euglena gracilis
SALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 21662 - protein, 832 aa, Schizosaccharomyces pombe
MMEHDVEDLINQLDISEKAMLLSGTDLWHTAAIPRLNIPSIRLSDGPNGIRGTSFFNSSPSACFPCGTALGATFDKKLLFEVGEYLAEEAKAKGVSVVLGPTVNIHRGPLNGRGFESFSEDSTLSGLAASYVILGLQSKNVQACIKHFVCNDMEDERNSVSIDVSQRALREVYLMPFQLACKYSNFKSLMTSYNKVNGEHVSQSRILLDNILRKEWEWKGTIISDWFGTYSLKKAIDAGLDLEMPGKPRFRNVNTIQHLVGSKELSESILDERAKNVLKLVKHSWQNTEAENHCELNNDSSCLREALKKFASQSIVLLKNKKKLLPLSRKGTFAVIGPNAKVCNYSGGGSANLKPYYTVSMYDGIAAKIDGVPEYALGCHNYLNLPNIANLLVNPRTGKHGYVAKFYLEPATSENRTLIDDYDLEDGVVRFYDYCNDKMKDGYFYIDIEGYLIPDEDAVYEFGISVFGTALLFIDDVLLIDNKTKQTPTNHTFEFGTIEERNSIYLKKGRKYNVRVEYGSAATYTLSTNLSPSTGGRYSIGCVKVIDPETEIDYAVRVAKSVDCVILCVGLTAEWETEGEDRKTMTLPSLSDKLVYSILQSNPNTVVVTQSGTPIEMPWISEAHTLLHIWYNGNELGNALANIIFGEQNPCGKLPITFPKKLKDNPAYLSFRSSRGHCVYGEDVFVGYKYYEAVEREVLFPFGYGLSYTTFELSNLYLKNCGERLRIDLEISNTGPMSGAEIIQVYISQIVRSVNRPVKELKEFSKVVLCPKETKLIRIELDIKYATSFYDELNEKWCSEEGEYNVLVGTSSKDIALTGKFTLPKTIHWTGL

SEQ ID NO: 21663 - protein, 785 aa, Neurospora crassa
MLTLFSSFDPSASSNLQHHNNNSQKRAFANGNGQGLPRFSICFMAAELLDSVPDPVLSDLDQKEAVAGLQGYQHPAVSANPDPVEAELEAKELSKYLLAKSFFDCKEFDRCASVFLPDSLLSGLLSTKATDATTPKGKAKASSAPPYEQALPSLSQKSLFLALYAKVISGEKKKNEESEMIMGPQDLGTIKNSHLVVVSRFLERWFAERKAEDSDLPPSQGFLEYLYGMVMVKEKNEDAALDYLLNSVHLFPWNWGAWLELTNLISGVEQLNKITPVLPQNIMSFIFYANTAVNLYQQGQDLAASVNDLLKLFPTSSFILTCRALLNYHSKDLYTAEQNFSNLLALHPHRLDSLDHYSNILYVLNMRPKLAFLAHLCSSIDKFRPESCVVIGNYYSLLSLHEKAVQYFRRALTLDRSCLSAWTLMGHEYVELKNTHAAIESYRRAVDVNRRDYRAWYGLGQTYEVLEMNSYALYYYKKAAGLRPWDGKMWQAVGSCLQKMGKDRDGIKALKRALLADSYYDSTLSSFGSAGPADRMAQMDPEVLLQIASMYDRLGEVEEARAYMELCVAQEDGGATDNADASAVCTSNPGESFVVHGDSPGSDGDAEGGYEGRGGAGQGEGTGVTVATSKARMWLARYAMRTEDYVTANRLATELCQDGVEVEEAKALIREKPPSLAFPNIEEYLPSAAMIRIGSNGGGGPKLRRVPRSQRYYENISTIPPLTDQGSGIYEDPSQESDDDDDDDDENGGNDRHDDWSGEDYLTDGYDDDDVDDDDDDNGGAPTNA

SEQ ID NO: 21664 - protein, 190 aa, Glycine max
VRDPILFPSFIHTQKRNPATHLKDVNMVWDFFTLRPESTHQAMFLFSDRGIPDGYRKMNGYGSHTFKLVNDKNEVVYCKFHMKTAQGIKNLPVDKAEQISAQDPDYSIRDLYNAIANGDYPKWNFFIQVMTVAQAEKNKFNPFDVTKVWSHKEFPLIPVGQLVLDRNPTNYFAEVEQIAFAPSHLVPGIE

SEQ ID NO: 21665 - protein, 334 aa, Burkholderia fungorum
MSRSSSRQPSALEADRRKLIDIYRTMVLVREVELSLSRLFADSEVPGFIHLSLGQEAVSAGVASVLEVQDTLATTHRGHGHVLARGIDVGGFFKEIMGRVGGLCKGRGGSMHVADLALGVLGANGIVGAGIPIALGSAVAHHVRKTRGVAVAFFGDGAMAEGVLHETMNMAALWKAPLLLVCENNGWSEFSPTERQFAARLEALAGAFGIAYKRVDGDDAVAVSEASGIAAAAARSGAGPFVLECVTHRVRGHYEGDPQKYRDPTELDGLAGKDPLKRMHTHLESAGVSASEIDQIGRAVLTRVEAAIEAARADALPDFDEASRDVYTGREAIV

SEQ ID NO: 21666 - protein, 484 aa, Staphylococcus aureus subsp. aureus N315
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 21667 - protein, 247 aa, Capsicum annuum
MGRGRVQLRRIENKINRQVTFSKRRSGLLKKAHEISVLCDAEVGLIVFSSKGKLFEYSTDSCMERILERYERYSYAERQLNATDVETPGSWTLEHAKLKARLEVLQRNQRHYAGEDLDSLSMKELQNLEQQLDSALKHIRSRKNQLMHESISELQKKDKALQEQNNNLSKQMKEREKQLAQQHTPWEQQNHDHLNSSSFGLPHPFNNNHLGEVYPTAGDNGEVEGSSRQQQQNAAVMPPWMLRHLNG

SEQ ID NO: 21668 - protein, 130 aa, Zea mays
  unsure (1)..(130): unsure at all Xaa locations
MADAPASPGGGGGSPTQSGSPQGRXGGGGGSXVREQDRFLPIANISRIMKKAIPANGKIAKDAKETVQECVSEFISFITSEASDKCQREKRKTINGDDLLWAMATLGFEDYIEPLKVYLQKYREMEGDSK

SEQ ID NO: 21669 - protein, 100 aa, Glycine max
KKAQMVVQVEAVRVQKELAAAEFDGYCEGELVKVTLSGNQQPVRTEITEAAMELGPEKLSLLITEAYKDAHQKSVQAMKERMNDLAQSLGMPPGLSEGLK

SEQ ID NO: 21670 - protein, 285 aa, Oryza sativa
  unsure (1)..(285): unsure at all Xaa locations
GFGCEEGSVLCGIFDGHGQWGHYVXKAVRESLPPALLRRWREAVTLAALIDGGEKRLCECRPDLWRQSYLAACAAVDAELRASRRLDAVHSGCTALSLVKHGDLLVVANVGDSRAVLATASPDDGGGARLAAVQLTVDFKPNLPQERERIMECNGRVQCLADEPGVHRVWRPDREGPGLAMSRAFGDYCVKDYGVISAPEVTHRRITAQDHFVILATDGDKHLNLFVWDVVSNEEAVQIVASAPEREKAAKRLVEFAVRAWRRKRRGIAVDDCSAICLFFHSPPS

SEQ ID NO: 21671 - protein, 335 aa, Medicago sativa
TPYTYTLRNTGPDDVYIKIHYCGVCHSDLHQIKNDLGMSNYPMVPGHEVVGEVLEVGSNVTRFKVGEIVGVGLLVGCCKSCRACDSEIEQYCNKKIWSYNDVYTDGKITQGGFAESTVVEQKFVVKIPEGLAPEQVAPLLCAGVTVYSPLSHFGLKTPGLRGGILGLGGVGHMGVKVAKALGHHVTVISSSDKKKKEALEDLGADNYLVSSDTVGMQEAADSLDYIIDTVPVGHPLEPYLSLLKIDGKLILMGVINTPLQFVTPMVMLGRKSITGSFVGSVKETEEMLEFWKEKGLTSMIEIVTMDYINKAFERLEKNDVRYRFVVDVKGSKFEE

SEQ ID NO: 21672 - protein, 357 aa, Cochliobolus carbonum
MAIPLPAFYKWDVYDSKLNNVHGHVECRYTAQTGYWSDPCFVQSPFLSVHGLAPGLNYGQQVYEGIQARRTARNEILIFRPGASADRMAKSATAVSMPPVPYELFVRSVHMAVALNADYVPPHDFHGSMYIRPCQFGSSCQIGLQPPDEFIFCVFVQPHIALHGHGSLRALIAEDFDRAATRGTGHVKIGGNYAPVIRWTQSAKKEENGGWDVLLHVDSKTQTRIDEFSTSAFIGTKYAEEQNEPPQIILPESAAAIQSITSDSVAWLAKSFGWNIVKQPVTIDELASLSEVMAVGTAAGLVPVSCIRHNSTNRTFEFPSAGPMYRQLKETLDNIQRGRSSDSFGWCEKLRYAEFVQ

SEQ ID NO: 21673 - protein, 196 aa, Glycine max
  unsure (1)..(196): unsure at all Xaa locations
LISFPISFSLFSSFTLFFAFLSSVICFIVSSLSFLSLLFSSAVFXXXXXIKAGADIVSVHCEQSSTIHLHRTVNQVKSLGAKAGVVLNPATPLSAIEYVLDVVDLVLIMSVNPGFGGQSFIESQVKKISDLRRLCAEKGVNPWIEVDGGVGPANAYKVIEAGANALVAGSAVFGAKDYAEAIRGIKTSKRPEVVAV

SEQ ID NO: 21674 - protein, 129 aa, Pseudomonas aeruginosa UCBPP-PA14
MAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKSMFRADGLLSPQRKVDSLAE

SEQ ID NO: 21675 - protein, 348 aa, Desulfovibrio desulfuricans G20
MECRPRHPQCLADKYRSLAAPCHNRHLRPAQHSAGFAEEDTMPLTGPKEMFARAYKEGYAIGAFNVNNMEIIQGIMQAGAEEKAPLILQVSAGARKYAGQTYIVKLIEAALSESDLPVVLHLDHGSGFDICKDCIDGGFTSVMIDGSHLPYEENIAVTRRVVEYAHDKGVWVEAELGQLAGVEEDVSAEHSVYTDPDQAVEFVERTGCDSLAIAIGTSHGAYKFTGKATLDFDRLSTITDKLPGFPLVLHGASSVPQEFVAMANQYGGEIGGAQGVPEDLLRKSASYGVCKINIDTDIRLAMTACIRKHFAENPADFDPRAYLKPAREAVKNMVQHKIRNVLGCSNKA

SEQ ID NO: 21676 - protein, 492 aa, Streptomyces avermitilis MA-4680
MLDQGAPPQSRSHPSAPGLGARLMRRKPVENLVAEGGQGEGGTLRRSLGLWQLTMISIGATLGTGIFVVLGEAVPKAGPAVTLSFVIAGLTALFSALSYAELAGTIPVSGSSYSYAYATMGELIAWICGWCLVLEYGVSVAAVAVGWGEYLNELLDGTIGVTIPDALSAPPGDGGIFNLPALIVVLLAMAFLLGGAKESARANTIMVIVKIAALLMFCAIGIQGFKSGNYENFMPLGMAGVSAAGATLFFSYIGFDAASTAGEEAKNAQRDLPRAIMLSLVIVTALYVLVAAVAVGAKPWKGFNDSEAALAGIMKDVTGQTFWGTLLAACAVIAIASVVLTVLYGQTRILFAMARDGLVPKVFARVHPKTGAPRANTVIVSLFCGVLAAAIPLGQLADATSIGTLFAFGLVNIAVVVLRRTRPDMRRTFRVPLSPVLPAIGFALCVWMMGSLSAVTWVVFGVWMAVGLVFYFSYGHRRSRLATADTAVSAQK

SEQ ID NO: 21677 - protein, 507 aa, Triticum aestivum
MATTSRLLLLLLLAAACLLAGAAVDALRLPPDASFPGAQAERLIRALNLLPGASSGRRGQVGAGAVDVAPGQLLERRVTLPGLPEGVGDLGHHAGYYRLPNTHDARMFYFFFESRGKKEDPVVIWLTGGPGCSSELAVFYENGPFTIANNMSLVWNKFGWDKISNIIFVDQPTGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYDRINKFIPPCEFAIKLCGTDGKASCMAAYMVCNSIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYAAM

SEQ ID NO: 21678 - protein, 196 aa, Selaginella lepidophylla
MADTEFFTEYGEASRYKIQEVIGKGSYGVVCSAIDTHTGEKVAIKKINDIFEHVSDATRILREIKLLRLLRHPDIVEIKHIMLPPSRREFKDIYVVFELMESDLHQVIKANDDLTPEHYQFFLYQLLRALKYIHTGNVFHRDLKPKNILANAYCKLKICDFGLARVAFNDAPTAIFWTDYVATRWYRAPELCGSFF

SEQ ID NO: 21679 - protein, 116 aa, Zea mays
  unsure (1)..(116): unsure at all Xaa locations
PHCLVGGFGGHRSLEQKNKSFNIRGSIYRSWTTNYETPVWNNNGVLTEGQQGPILLEDYHLTEKLAQLDRXRIPERVVHARGAXRADSFEVTHDDNHPTCADYLRAPGVHTPVIVR

SEQ ID NO: 21680 - protein, 484 aa, Oceanobacillus iheyensis HTE831
MEKRTTLKKTLKPHWVWAIALGSSIGWGAFVQPAAWMGTAGPLGAMIGFGIGGLLMMLIAVSYGFLIKSFPVSGGEFAYAFISLGRTHAFISGWFLTLGYICIVALNASALALMFKFVFPSVLENFYMYQIADWDVYGMEIIIASIALIIFGYLNIRGGGFTGSAQFIFCIIMVGGVLLLTTLVGINPSADISNVAPLFPSDKTAIAAILSIVAIAPWAFVGFDNIPQAAEEFNFSSKKAFRLIILAILFATILYCLMIFATAMAQPWEGLVAAGHNWGTAEALQDILGTVGVAILAIALLMGIFTGLNGFIISTSRLLFAMSRAKFIPRSFSKLGKNETPYISIIFTVIVAMVAPWFGRQALTWVVDMSSVGVTIAYFYTCYTAFSLFKWNDNHGFNTNKHVVAPGKKIFALLGMVASISFLGLLLIPGSPAFLGLESRIALVVWIVLGIIFYIMKYKDYKNLDKEEMNYLILGSKEIKVKKD

SEQ ID NO: 21681 - protein, 481 aa, Oryza sativa
RPGPYMPRPPAVPEWLNTGDNGWQLAAATFVGLQSMPGLVVLYGSIVKKKWAVNSAFMALYAYASTLIVWVLVGFRMAFGDRLLPFWGKAGAALTEGFLVARASVPASPRTEPFYPEASMVLFQFELAAITLVLLAGSLLGRMNIKAWMAFTPLWLLFSYTVCAFSLWGGGFLYQWGVIDYSGGYVIHLSSGIAGFTAAYWVGPRLKSDRERFSPNNILLMIAGGGLLWLGWAGFNGGAPYAPNITASIAVLNTNVSAAASLLTWTCLDVIFFGKPSVIGAVQGMMTGLVCITPGAGLVHTWAAILMGICGGSLPWFSMMILHKRSALLQKVDDTLAVFHTHAVAGLLGGFLTGLFALPDLTAVHTHIPGARGAFYGGGIAQVGKQIAGALFVVVWNVVATTVILLGVGLVVPLRMPDEQLKIGDDAAHGEEAYALWGDGERFDVTRHEGARGGAWGAAVVDEAMDHRLAGMGARGVTIQL

SEQ ID NO: 21682 - protein, 315 aa, Zea mays
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNMVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 21683 - protein, 568 aa, Arabidopsis thaliana
MAAGRRKLSESAPLEEEGNDGNGAVVGKKPSKSVKRTTKKKVVVKDEPLEEISEFLVDNDDVLDKESIVSALKPKKTRTRKKASSDVEEVKTEKKVRRKRTVKKDKDVEDDLATIMDAEVSDVEEALAVESTDTESEEEEIDLSKHEGEDISHTYGWPPLVCCFGSAQHAFVPSGRPANRLLDYELHERMRDAKWAPEKYIRAPGGCAGGVAIALASLGGKVAFMGKLGADDYGQAMLYYLNVCKVQTRSVKIDGKRVTACSTMKISKRGRLKSTCIKPCAEDSLSKSEINVDVLKEAKMFYFSTHSLLDKKMMSTTIQAIKISKQLGNVIFYDLNLPLPLWHSSEETKSFIQEVWNLADVIEITKQELEFLCGIEPTEEFDTENNDISKFVHYPPETVEQLWHENLKVLFVTNGTSKIHYYTKEHNGAVSGMEDVPITPFTRDMSASGDGIVAGLIRMLTVQPDLMNNKGYLERTARYAIECGIIDQWLLAQTRGYPPKDDMEEEEDDEEEDEVESDPNGIRSITEKEYRTSKPYDEPDGPYVMKPVEEREYKKLELVGSMFEDGSL

SEQ ID NO: 21684 - protein, 311 aa, Zea mays
MLGCRKADPDLEAGRPSIQVVRASEPTIRLLFVFVLSLPSCRSPAPSSPLRRPSCETLARRAREKLAAMFGYRKADPDLEAGGSSLLYPGMTESPELRWAFVRKIYVILAVQLAMTAAVSAFVVKVPAVSNFFVSSNAGVALYIFLIILPFLVLCPLRYYHQKHPVNLLLLGLFTVAISFAVGMTCAFTSGKIILEAAILTAVVVISLTAYTFWAAKRGHDFNFLGPFLFAAIMVLMVFSLIQIFFPLGKISVMIYGGLASLIFCGYIIYDTDNVIKRYTYDEYIWAAVSLYLDVINLFLSLLQLLRAADS

SEQ ID NO: 21685 - protein, 402 aa, Oryza sativa
DAGEEEDDAAAVLTLEELRLGETSEEFTGTSSLSTTNDDETSSTTTESMFYISPNGRFRRKIRSWNRGMLLGSGSFGTVFEGISDEGVFFAVKEVCLCDQGSNAQQCIFQLEQEIALLSQFEHENIVQYYGTDKEDSKLYIFLELVTQGSLASLYQKYRLRDTHVSAYTRQILNGLTYLHERNIVHRDIKCANILVHANGSVKLADFGLAKEITKFNVLKSCKGTVYWMAPEIMMKFQVVNPKTTYGPEADIWSLGCTVLEMLTRQLPYPGLEWVNAVDKVYEDIFALKFIGTRHKWIELRTASEYRWNGTDDVNMHVRGGDLFVFAIICRALPNFGTSDDSSLGWNCRACLLVRTKGVRQLINDSYAVVRVFQRKSYDWLVVVLQLAVWRLQPRRDWHLAS

SEQ ID NO: 21686 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFININRSNVVL

SEQ ID NO: 21687 - protein, 390 aa, Oryza sativa
FFTDAYDLFCISTVSKLLGRLYYQPDGSTDSKPGALSKTANNMVIGVALVGTLMGQLVFGYFGDKLGRKRVYGVTLILMAACAIGSGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANLGPN

SEQ ID NO: 21688 - protein, 294 aa, Bacillus subtilis subsp. subtilis str. 168
MAQTGTERVKRGMAEMQKGGVIMDVINAEQAKIAEEAGAVAVMALERVPADIRAAGGVARMADPTIVEEVMNAVSIPVMAKARIGHIVEARVLEAMGVDYIDESEVLTPADEEFHLNKNEYTVPFVCGCRDLGEATRRIAEGASMLRTKGEPGTGNIVEAVRHMRKVNAQVRKVVAMSEDELMTEAKNLGAPYELLLQIKKDGKLPVVNFAAGGVATPADAALMMQLGADGVFVGSGIFKSDNPAKFAKAIVEATTHFTDYKLIAELSKELGTAMKGIEISNLLPEQRMQERGW

SEQ ID NO: 21689 - protein, 195 aa, Staphylococcus epidermidis ATCC 12228
MILMIDNQDSFTYNLIDYIKVQTTEEVKIISVNDLMTQHLDALNPRAIVISPGPGKPSDYPILSSVLEIFHRHVPILGVCLGFQLIIEYFGGNIIHNDKPIHGHITKIRHSNEGIFKGLPSYFNVMRYHSLMADPSTIPSALKVTALNNENVIMAVAHHKYPIYGLQYHPESILSEYGHEQLNLFLTEVGVKYAH

SEQ ID NO: 21690 - protein, 456 aa, GIBBERELLA ZEAE PH-1
MTSSAKLGENPISTLANGQPTENPGSTQQIRYGQSNGGLVVLSDTQTIEILAHFARERIPERSVHAKAAGATGEFEVLEDLSDITDANFLSEKGKKTPMLMRISTVGGEKGSADTVRDVRGWSTKLYTEEGIQDFVFNDLPVFFIREPIKFPSMNRSHKRHPRTNVPDNAMFWDYHVNNPEGIHALMHLFGQRGIPASLRHISGFGVHTYTLNKADGSYVYVKWHYKPEGGIETMDSETAARLAGTDPDYHVKDLFNAIEKGDYPSWIVYIQVMRPEEVMAAPIDIFDCTYTWPHEKYPLRRVGQMTLKKNPDNYFQDIEQACFSPSNMVPGIGPSADPVLQARMFSYPDAHRYRVGPNYFQLPPNRPRNQVYAPCVRDGPGTMNGNYGGDPDYVFSQLRPVSARELWKIICGEDKGKRQFFNNIAPTIKDLPVKLQDYLSGVDPEIKTILTAHMN

SEQ ID NO: 21691 - protein, 205 aa, Eucalyptus globulus
MGRGRVQLKRIENKINRQVTFSKRRCGLLKKAHEISVLCDADVALIVFSTKGKLFEYATDCCMERILERYERYSYAESQVLTNNAETNGNWTLEHAKLKARMEILQKNQKNLMGEELDSLSLKELQNLEHQLDTALKNIRSRKIQLMCESISELQRKDKALQEQNNMLAKKVKEKEKALAQQTQWDNPQDDGLTSSSGSLPSEWN

SEQ ID NO: 21692 - protein, 537 aa, Spinacia oleracea
MRSEVPSSTSPSFLSPPFIHLPLLSLSSPTPLPHSSSSTFSLFSTMAASQIGLVGLAVMGQNLALNIAEKGFPISVYNRTASKVDETLDRAKSEGDLPLSGHYTPRDFVLSIERPRSIVILVKAGSPVDQTIASLASFMEPGDTIIDGGNEWYQNTERRLSDAHSNGLLYLGMGVSGGEEGARFGPSLMPGGDFQAYDNIQHILKKVAAQVDDGPCVTYIGEGGSGNFVKMVHNGIEYGDMQLISEAYDVLKNVGGLSNEELGQIFDEWNKSELESFLVEITADIFKVKDDLADGGLVDKILDKTGMKGTGKWTVQQAAELSVAAPTIAASLDCRYLSGLKEERENAAKILEAAGMKEEVNAIRGGVDKKRLIDDVRQALYASKICSYAQGMNLLRAKSAEMGWDLNLGELARIWKGGCIIRAVFLDSIKQAYQRNPNLASLVVDPEFAKEMVQRQAAWRRVVGLAVSAGISTPGMCASLAYFDTYRRARLPANLVQAQRDYFGAHTYERVDLPGSYHTEWSKLARKSDPNVAAALH

SEQ ID NO: 21693 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAAPEGPLKGIMGYVEEDLVSTDFLGDSRSSIFDAKAGIALNDHFVKLVSWYDNEWGYSNRVVDLIRHMFKTQ

SEQ ID NO: 21694 - protein, 318 aa, Carica papaya
MENFPVIDLSKLNGEERASTMELIHDACENWGFFELVNHGISHDLMDTVERLTKEHYKKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVSNYPPCPKPDLIKGLRAHTDAGGIILLFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 21695 - protein, 361 aa, Oryza sativa
  unsure (1)..(361): unsure at all Xaa locations
KATAAGPSRDGSATAGRRRRCIAHGAAGDALRVGAXSHATRLVDLVTSPWPAHVIASKHAAASSRAPPRAARTALAHRVCTGNVVEAVGHVRSVMGEIHALRNMDDDEVFAYAKRIAAPYNLVMQTKQLGRLPVVQFAAGGVATPADAALMMQLGCDGVFVASGIFKSGDPARRARAIVQSVTHCRSSRPSTLPPRRPCWHTFAVELCPNRYMVMEAFIDTAGKDQSDPLILTQLNSTKAIRDSIQINFGECGLAACLGSLQGIYELYSSIVKYVNPITKLCVIRVSREDHQKVWAAITMVRSIGKIPVSFNLRDVSGSIRACKKAALECEEAKFEYYKLAAGDRITPKFVETMESCFNKD

SEQ ID NO: 21696 - protein, 187 aa, ASPERGILLUS NIDULANS FGSC A4
MTTEEAEIKDERLETPHEEGGDDEEEIEAMKRRVAEMESEAAKLREMQATLDQQSESLKEDKEDIDARSIFVGNVDYGASPEEIQAHFQSCGSINRVTILLDKFTGQPKGYAYVEFAEPSLVAQALVLNESVFRGRNLKVVPKRTNLPGMSSRGRGRGRGRGYGRGGFPRGGYRGGYRGRGRGYAPY

SEQ ID NO: 21697 - protein, 248 aa, Zea mays
  unsure (1)..(248): unsure at all Xaa locations
PRVRAEYVVESTGGFTDQGKAGSXLEGGAQKGGIFSSNKGAPMFVGGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNITK

SEQ ID NO: 21698 - protein, 451 aa, Neisseria gonorrhoeae
RFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKVDHEFLLRGGVFSKDWIDSYIAFKEEDVRRIRMAPHPLEF

SEQ ID NO: 21699 - protein, 397 aa, Nitrosomonas europaea ATCC 19718
MKLSQRVQAIKPSPTLAVTAKAARLKAEGKNIIGLGAGEPDFDTPLHIKDAAITAIRNGFTKYTAVGGTASLKQAIISKFKRENSLEFMPGEILVSSGGKQSFFNLVLATIDPGDEVIIPAPYWVSYPDIVLIAEGKPVFIDTGIEEKFKISPDQLEKAITPRTRMFVVNSPSNPSGSVYSLEELQALGAVLRKYPDILIATDDMYEHILLSGDGFVNILNACPDLKARTVVLNGVSKAYAMTGWRIGYCGGPAAIITAMENIQSQSTSNPNSIAQVAAEAALNGDQSCMVPMIEAFRERNQFLTNALNSIAGIHCLLSEGAFYAFVDVRQAISRLNTQQILQNSSDIAFCNYVLEKAEVAAVPGSAFGCEGYMRLSFATSMDNLQEAVKRIASLLS

SEQ ID NO: 21700 - protein, 199 aa, Zea mays
  unsure (1)..(199): unsure at all Xaa locations
MTAKGGATPSPGGAGPAAGNGRLFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTGVFAYVMTVKRESWVTYLTLVPVVTGVIIARGGEPSFHLFGFIMCIGATGARXALKTVLQGILLASGG

SEQ ID NO: 21701 - protein, 253 aa, Arabidopsis thaliana
SWTPRAFLYKGFLSDEECDHLIKLAKGKLEKSMVVADVDSGESEDSEVRTSSGMFLTKRQDDIVANVEAKLAAWTFLPEENGEALQILHYENGQKYDPHFDYFYDKKALELGGHRIATVLMYLSNVTKGGETVFPNWKGKTPQLKDDSWSKCAKQGYAVKPRKGDALLFFNLHLNGTTDPNSLHGSCPVIEGEKWSATRWIHVRSFGKKKLVCVDDHESCQEWADAGECEKNPMYMVGSETSLGFCRKSCKAC

SEQ ID NO: 21702 - protein, 192 aa, Xanthomonas campestris pv. campestris str. ATCC 33913
MLLMLDNYDSFTYNLVQYLQALGAEVTVVRNDAMSVDQIAALKPERIVISPGPRTPNEAGISLQLIEQLGQTTPILGVCLGHQSIGQVYGGDVIRASNIMHGKTSPIRHHGKGVFAGLPDSYEATRYHSLVVDKATLPDALEVTAWTENPDGSMEEIMGLRHRQFPVEGVQFHPESILTQHGHALLKNFLER

SEQ ID NO: 21703 - protein, 213 aa, Zea mays
  unsure (1)..(213): unsure at all Xaa locations
MAHHRRRLLHSPSIHLPPHPAAALLFSPLSLTETFPREDTKAPGSRKPIHSIPHKARHKRTKAAMIRTKGEAGTGNVVEAVRHVRSVMGDVRALRSMDDDEVFAYAKRIAAPYDLVMQTKQLGRLPVVQFAAGGVATPADAALMMQLGCDGVFVGSGIFKSGDPARRARAIVQAVTHYSDPTILADVSXGLGEAMVGINLNDPKVERYAARSE

SEQ ID NO: 21704 - protein, 254 aa, Salmonella typhimurium LT2
MNSQFAGLTREACVALLASYPLSVGILAGQWIALHRYLQQLEALNQPLLHLDLMDGQFCPQFTVGPWAVGQLPQTFIKDVHLMVADQWTAAQACVKAGAHCITLQAEGDIHLHHTLSWLGQQTVPVIGGEMPVIRGISLCPATPLDVIIPILSDVEVIQLLAVNPGYGSKMRSSDLHERVAQLLCLLGDKREGKIIVIDGSLTQDQLPSLIAQGIDRVVSGSALFRDDRLVENTRSWRAMFKVAGDTTFLPSTA

SEQ ID NO: 21705 - protein, 1025 aa, Yarrowia lipolytica
MPSISHKPITAKLVAAPDATKLELSSYLYQQLFSDKPAEPYVAFEAPGIKWALYPASEDRSLPQYTCKADIRHVAGSLKKFMPVVLKRVNPVTIEHAIVTVPASQYETLNTPEQVLKALEPQLDKDRPVIRQGDVLLNGCRVRLCEPVNQGKVVKGTTKLTVAKEQETIQPADEAADVAFDIAEFLDFDTSVAKTRESTNLQVAPLEGAIPTPLSDRFDDCESRGFVKSETMSKLGVFSGDIVSIKTKNGAERVLRLFAYPEPNTVKYDVVYVSPILYHNIGDKEIEVTPNGETHKSVGEALDSVLEAAEEVKLARVLGPTTTDRTFQTAYHAGLQAYFKPVKRAVRVGDLIPIPFDSILARTIGEDPEMSHIPLEALAVKPDSVAWFQVTSLNGSEDPASKQYLVDSSQTKLIEGGTTSSAVIPTSVPWREYLGLDTLPKFGSEFAYADKIRNLVQISTSALSHAKLNTSVLLHSAKRGVGKSTVLRSVAAQCGISVFEISCFGLIGDNEAQTLGTLRAKLDRAYGCSPCVVVLQHLESIAKKSDQDGKDEGIVSKLVDVLADYSGHGVLLAATSNDPDKISEAIRSRFQFEIEIGVPSEPQRRQIFSHLTKSGPGGDSIRNAPISLRSDVSVENLALQSAGLTPPDLTAIVQTTRLRAIDRLNKLTKERPIATLDDLLTLSHGTLQLTPSDFDDAIADARQKYSDSIGAPRIPNVGWDDVGGMEGVKKDILDTIETPLKYPHWFSDGVKKRSGILFYGPPGTGKTLLAKAIATTFSLNFFSVKGPELLNMYIGESEANVRRVFQKARDAKPCVVFFDELDSVAPQRRNQGDSGGVMDRIVSQLLAELDGMSTAGGEGVFVVGATNRPDLLDEALLRPGRFDKMLYLGISDTHEKQQTIMEALTRKFRLAADVSLEAISKRCPFTFTGADFYALCSDAMLNAMTRTANEVDAKIKLLNKNREEAGEEPVSIRWWFDHEATKSDIEVEVAQQDFEKAKDELSPSVSAEELQHYLKLRQQFEGGKK

SEQ ID NO: 21706 - protein, 636 aa, Haemophilus somnus 129PT
MKKEKTLDLICLGRVAVDLYAQQIGSRLEDVSSFAKYLGGSSGNVAYGTAVQGVKSSMLARVGDEHMGRFLREELQRLGVDTSHLITDKERLTALVILGIKDQDTFPLIFYRDNCADMAITADDFDEEYIASAKALAITGTHLSHPKTRHAVLTALEYAGRNGTKRLLDIDYRPVLWGLTSLGDGETRFIDSEAVTQSLQEVLHHFDVLVGTEEEFHIAGGSTDTLTALKNVRKVSNATLVCKRGALGCSVFEGDIPNHIDGGINVYGVRVEVLNVLGAGDAFMSGLLRGYINGESWEQCCRYANACGALVVSRHGCAPAMPTKEELDNYLSRAESVPRPDLDEQLNHLHRVTTRKQQWHDLCIFAFDHRKQLVDMAEKCGADLKRIPTLKTLLLKAAEQTAQKEGIYNGNAGVLADTTFGQEALNEITGKKWWIGRPIEMPSSRPLRLEHGDLGSQLISWPAEHVVKCLAFYHPADKAELKADQDATLKEVYRACCRTGHELLLEIILPADMEQKESYYTDMIAHFYSLGIKPDWWKLPGVSAKTWADISQVIEKNDKHCRGILILGLDAPEAVFENVFKASANAPLVKGFAVGRTIFGQPSADWLAGKIDDEQLIKETSERYRRLIKLWKNRKN

SEQ ID NO: 21707 - protein, 328 aa, Zea mays
  unsure (1)..(328): unsure at all Xaa locations
MEAEKKPPAVSDVGAWAMNVVSSVSLIMANKQLMSSSGYAFAFATTLTGFHFTVTALVGWISNATGYSVSKHVPLWELVWFSLVANTSITGMNLSLMLNSVGFYQISKLSMIPVVCLMEWVLNSKHYTTKVISAVIVVAAGVGICTVTDVEVNAKGFICACVAVFCTSLQQITIGSFQKKYNIGSFELLSKTAPIQALSLIILGXPFVDYYLNGPXLLNYPFSGGATFFILXRFSATSFQVLGHMKTVCVLILGWILFDSALTVKNILGMLLAVMGMVVYSWAVEAEKKAAAPIPRNKGGMLDGEDVPLKARVSGVPAVDLEDGDVKG

SEQ ID NO: 21708 - protein, 519 aa, Staphylococcus aureus subsp. aureus MW2
MKIKAQVAMVLNLDKCIGCHTCSVTCKNTWTNRPGAEYMWFNNVETKPGVGYPKRWEDQEHYKGGWVLNRKGKLELKSGSRISKIALGKIFYNPDMPLIKDYYEPWNYNYEHLTTAKSGKHSPVARAYSEITGDNIEIEWGPNWEDDLAGGHVTGPKDPNIQKIEEDIKFQFDETFMMYLPRLCEHCLNPSCVASCPSGAMYKRDEDGIVLVDQDACRGWRYCMTGCPYKKVYFNWKTNKAEKCTFCFPRIEAGMPTVCSETCTGRMRYLGVLLYDADRVHEAASAVDEKDLYEKQLDIFLNPFDEEVIAQAEKDGIGYDWIEAAQNSPIYKLAIEYKLAFPLHPEFRTMPMVWYCPPLSPIMSYFEGKNTTQNPDAIFPAIEEMRLPIEYLANIFTAGDTEPVKGALQRMAMMRSYMRSQVTQQPFDTSRLERLGITERQTKDMYRLLGLAKYEDRFVIPTSHKETYLDTYHAQGSTGYNYGGEHFGDNCEGCGVAVGSGKTGQEIYNENFYGGIFRD

SEQ ID NO: 21709 - protein, 277 aa, Salmonella enterica
QLPSGSELSLYDIASVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKGVVECAYVEGDGQYARFFSQPLLLGKNGVEERKSIGTLSAFEQHSLDAMLDTL

SEQ ID NO: 21710 - protein, 296 aa, Oryza sativa
LRESNGGGGGSPKEAAVVVPSSGDATLGGHLARRLVQVGVSDVFAVPGDFNLTLLDHLIAEPGLRVVGCCNELNAGYAADGYARARGVGACAVTFTVGGLSVLNAIGGAYSENLPLICIVGGPNSNDYGTNRILHHTIGLPDFSQELRCFQTITCYQAVINNLDDAHEQIDTAIATALRESKPVYISLGCNLGGLFNPTFSRESVPLFISPRLSNKANLEHAVEAAADFLNKAVKPVMVGGPKIRVAKAKKAFAGIAESSGYPFAVMPSAKGLVPEHHPRFIGTYWGAVSTTFCAE

SEQ ID NO: 21711 - protein, 182 aa, Streptomyces coelicolor A3(2)
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEVSSAEIEVHAEDLTAGDRVLVVDDVLATGGTAKASLELIRRAGAEVAGLAVLMELGFLGGRARLEPALAGAPLEALLTV

SEQ ID NO: 21712 - protein, 522 aa, Uromyces viciae-fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 21713 - protein, 393 aa, Nicotiana tabacum
MDGPAHQTDTVMSDAAGQQPAPPSQPVAGIDNIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRITVEDALAHPYLTSLHDISDEPVCMTPFNFDFEQHALTEEQMKELIYREGLAFNPEYQHM

SEQ ID NO: 21714 - protein, 221 aa, Escherichia sp. Souza-273
DLLDADYMAYMLKYDSTHGRFNGTVEVKDGHLVVNGKKIRVTAERDPANLKWDEVGVDIVAEATGLFLTDETARKHITAGAKKVVLTGPSKDNTPMFVKGANFDKYEGQDIVSNASCTTNCLAPLAKVINDNFGIVEALMTTVHATTATQKTVDGPSHKDWRGGRGASQNIIPSSTGAAKAVGKVLPELNGKLTGMAFRVPTPNVSVVDLTVRLEKAASYE

SEQ ID NO: 21715 - protein, 548 aa, Oryza sativa
MVAEAKQGEGKEAGQARPQQCGQGSVTARGEDGEYVQGQFGGQMRVRRSAAEQARQRVGNKRERGRGGAAGKSDRWRSGGRRAAGECGGAEGLVAHQAMARAGSCAGWASSDGLASRLPLPPKLVRPAATDRDDDEEDDDEDTVLLGIVRHIPCAFDSANRLLSSSPAAAVALMVPISSALWPFGLHAGHLTCLPLRCAGCAFWRKGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKGYRSVMSASEGKLKGIIGYVEEDLVSTDFVGDSRSSIFDAKAGIALNDNFVKLVAWYDNEWGYSNRVIDLIRHMAKTQ

SEQ ID NO: 21716 - protein, 455 aa, Oryza sativa
MGQQQQQENLTLLPMSSSSAAAAADAAAASSPAASAGRLFTAGLVASWYASNIGVLLLNKFLLSTYGFRYPVFLTACHMSACALLSYAAAAASAAAPRAARPRRSRGQLARVALLGAVFCASVVAGNVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTMLTMFNALLDSYQVLGNAKGAVAVVVSILIFRNPVTFMGMLGYGITVAGVVLYGEAKKRSKAGMFSFAVSAAAAAAAATTGQGWGIRRPDGLEPFPWVSASALVGAWSLLFLREGDNEEDRVLKLSDVWLIFPTVEAVEAPETTELKLSTELLGEMLGDTRLLLPPVGILFLDALAGILPIEAAVAAADDDNDDGKAPDFEVEILK

SEQ ID NO: 21717 - protein, 479 aa, Phitymorphora linearis
AIKNERYESGVIPYAKMGYWDPNYVIKETDVLALFRVTPQPGVDPVEASAAVAGESSTATWTVVWTDLLTACDLYRAKAYKVDAVPNSSEQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYSMEAVNRSIAASGEVKGHYMNVTAATMEEMYERAEFAKQLGTVIVMIDLVIGYTAIQSMGIWARHNDMILHLHRAGNSTYSRQKSHGMNFRVICKWMRMAGVDHIHAGTVVGKLEGDPLMIRGFYNTLLLAHLDINLPQGIFFQQDWAALRKVTPVASGGIHCGQMHQLLDYLGDDVVLQFGGGTIGHPDGIQAGATANRVALESVVIARNEGRDYVAEGPQILRDAAKTCGPLQTALELWKDITFNYTSTDTADFVETPTANV

SEQ ID NO: 21718 - protein, 274 aa, Brucella melitensis 16M
MEQRLWETVTRLAPLQPDFVSVTYGAGGSTRERTVRTVARILKETDIKPAAHLTCVDATREDVDRVAREFAALGVNRFVALRGDPANGIGEKYVPTPGGYQNGAELVGGLRNIADFDISVSAYPEKHPESPDFATDIDMLKRKVDNGATRAITQFFFENDLYERYVERVRRAGIYIPIVPGVLPVHNFKQVRNFCARSATHIPAWLAERFDGLDNDPQTHQLVAAAIAAEQVMDLIERGVQDFHFYTMNRADLPFAICHMIGIRPKTQAALEVA

SEQ ID NO: 21719 - protein, 501 aa, GIBBERELLA ZEAE PH-1
MAPKTTMSDPDPENMCPGSGPMHRAQQQSKRPYSQYKNGEHRISIISVYIMMPSVRRFHGQTMVAAAPSICSGPAASSTIKMASSSASWTTYLWRLILAVLAPSTALLPFGAWVVSVWGSPVLDLHVQPHFSVQQKAPIQTGIPFEISTTSGFNCFNPNLPNVTIYATGGTIAGSASSADQTTGYRSAALGVDSLIDAVPQLCNVANVRGVQFANTDSIDMSSAMLRTLAKQIQNDLDSPFTQGAVVTHGTDTLDESAFFLDLTIQSDKPVVVTGSMRPATAISADGPMNLLSSVTLAAAASARGRGVMIAMNDRIGSARFTTKVNANHLDAFQAPDSGMLGTFVNVQPVFFYPPSRPLGHRHFDLRPITNNGRRFGRSTAPGAGSSALPQVDVLYAYQELSVGMFQAAIDLGAQGIVLAGMGAGFWTSKGTEEIRRIVHETDIPVIVSRRPEGGFVGPCEAGIGAGFLNPQKARIQLQLALETKMDNDAIKALFEHSGVH

SEQ ID NO: 21720 - protein, 179 aa, Oryza sativa (japonica cultivar-group); identical to SEQ ID NO: 16156

SEQ ID NO: 21721 - protein, 187 aa, Fusobacterium nucleatum subsp. vincentii ATCC 49256
MEKLKRFDKAEEYHQDYLKKNPNGYCHINLNKANEAIIDEKKYQKPSDEVLKEKLSDLEYQVTQEAATERAFTHEYYKNQEDGIYVDITTGEPLFSSKDKYDAGCGWPSFTKPIATEVVNYKKDSSHGMNRVEVRSRAGEAHLGHVFEDGPRDKGGLRYCINGASLRFIPYDKMDEEGYGEFKKYVK

SEQ ID NO: 21722 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 21723 - protein, 303 aa, Enterococcus faecalis V583
MNAVTIIGSINLDTTLRVKEMPKPGETIHAIEHFTAGGGKGANQAVAAKRSGAETYFIGAVGNDGAGAMMTDLMSQDEINLTGVTTLEKTATGQAFIMVDNAGENSIMIYAGANNAFTPKQVQEHQEIIEKSDFVIAQFESAIDSTIAAFKIAKKAGVKTILNPAPALEQVPEELLNVTDMIVPNETETEILTGIKITDEASMRKAAEALHQLGIEAVIITVGSKGAFYDVNGRSGIVPAFKVKAVDTTAAGDTFIGALSSILEKDFSNLEEAIRYGNKASSLTVQRFGAQPSIPYQHELADK

SEQ ID NO: 21724 - protein, 36 aa, Arachis hypogaea
LWRKFDDSFMRPVFGGRGFVPVEPGSPTERNGHGWH

SEQ ID NO: 21725 - protein, 102 aa, Beta vulgaris
MASSSSSSPVALSKRGRPRNSGAKNPVFCSVDGCASDLNQCREYHRRHKVCERHSKTPVVLVGGKKPQFCQHCSGCKKIIREESNAQRLPCLSWLENPTGDF

SEQ ID NO: 21726 - protein, 390 aa, Argania spinosa
MALKLCFPPHKMPSFPDARIRSHTVFMASTIRSPSMEVGKVKKPFTPPPEVHVQVTHSLAPEKREIFNSLNNWAQENILVLLKDVDKCWQPSDFLPDSASEGFDEQVMELRTRCKEIPDDYFILLVGDMITGEALPTYQTMLNTLDGVRDETGASLTPWAIWTRAWTAEENRHGDLLNKYLYLSGRVDMKQIEKTIQYLIGSGMDPRTENNPYLGFIYTSFQARATFISHGNTARLAKEHGDLKLAQICGIIAADEKRHETAYTKIVEKLFEIDPDGTVLALADMMRKKVSMPAHLMYDAQDDNLFENFSSVAQRLGLYTAKDYADILEFLVGRWDIEKLTGLSGEGRKAQDYVCTLPPRIRRLEERAQSRVKNASATPFSWIFGREINL

SEQ ID NO: 21727 - protein, 282 aa, Perilla frutescens
GSWRSLPKLAGLLRCGKSCRLPWTNYLRPDIKRGPFSTEEEKLVIQLHGILGNRWAAIASQLPGRTDNEIKNLWNTHLKKRLLLMGIDPHTHEPSLTSNGLLTRPPSSPSTRHMAQWESPRLDAEARLSKESLLSIHAPLPKSEADHFLRLSNSEVGETFRKIKNGEKAEPPSPSQSPGSSASTKCCSFSGTTTEIGLQSGLHETDCKSSKTCTEYVRTGTDSSSSNEMEDSSESTLQLLLDFPCKNDMSFLGNADCYSLYPGFTNGSLYDSSSQEKKGGFV

SEQ ID NO: 21728 - protein, 448 aa, Schizosaccharomyces pombe
MGQAQSGNFSNFGDGANGDNKKDQKKDKPKYEPPVPTRTGRRKKKAQSGPDASAKLPTVIPTTRCRLRLLKMQRIHDHLLMEEEYVQNQERLKPQDERTQEERNRVDEIRGTPMSVGTLEEIIDDDHAIVSTAGPEYYVSIMSFVDKDMLEPGCSVLLHHKAMSIVGLLLDDTDPMINVMKLDKAPTESYADIGGLESQIQEIKEAVELPLTHPELYEEMGIKPPKGVILYGAPGTGKTLLAKAVANQTSATFLRVVGSELIQKYLGDGPRLVRQLFNAAEEHSPSIVFIDEIDAIGTKRYDAQSGAEREIQRTMLELLNQLDGFDTSQRDIKVIMATNRISDLDPALIRPGRIDRKILFENPDEATKRKIFTIHTSKMNLGEDVNLEELIQCKDDLSGAEIKAIVSEAGLLALRERRMRVVMDDFRQAREKVLKTKDEGGPAGGLYI

SEQ ID NO: 21729 - protein, 184 aa, Oryza sativa
LHLVGVSAMLIACKYEEIWAPEVNDFILISDSAYTREQILAMEKGILNKLQWNLTVPTAYVWVMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 21730 - protein, 350 aa, Pseudomonas fluorescens PfO-1
MPQPRPYKVALNGYGRIGRCVLRALFERGSAAGFEIVAINDLADMASIEYLTRFDSTHGRFPGEVKVEGDCLHINGHCVKVLRSATPEGIDWASLGVDLVLECSGAWHTRADGQRFLDAGAPRVLFSQPMASEADVDATIVYGVNQDCLTGDELLVSNASCTTNCGVPLLRLLDQAVGLDYVSITTIHSAMNDQPVIDAYHHEDLRRTRSAFQSVIPVSTGLARGIERLLPELAGRIQAKAVRVPTVNVSCLDITMQTASDTDAGEVNRILRDAATSGPLKGLLAYTELPHASCDFNHDPHSAIVDASQTRVSGPRLVNILAWFDNEWGFANRMLDVAEHYLQTATSKKP

SEQ ID NO: 21731 - protein, 377 aa, Prochlorococcus marinus subsp. marinus str. CCMP1375
MESSKNKPLNKIPPARLEVEQMTPYSAPLEGRRDLLRLDFNENTIGPSPKVLNAIKKITSEQISIYPEYLGLQKAVVNNLNSPYFVSLLKPNQIGLFNGVDSAIHSIFYAYGDRNKQYLTTLPTFGYYKPCASMQGMKAIEISYEGSDFKFPLQAIRNSLIKLKPTILIICNPNNPTGTTLSATKILELAHLSPKTLVVVDELYEAFLGDSVLPVVDFRKTPNLVVLRSLSKTSGLAGLRIGFAIGHPGVIDRITRVTGPYDINSFAVTAAFAALTDQEYVDNYVAEVLQARIWIQKRLCANKVRHHMDAGNYFLLWPTHQSHNDVETSLKSAGILVRNMKNKPLIHGSLRVSIGTTLQMKSFWETYKNVDKFKALN

SEQ ID NO: 21732 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 21733 - protein, 545 aa, Zea mays
MAAASSAHLFGLGDGQMQMQPQQQQQAPPPPLVNNPAAPPPKKKRNQPGNPNPDAEVIALSPKTLMATNRFVCEVCNKGFQREQNLQLHRRGHNLPWKLKQKNPKETRRRVYLCPEPTCVHHDPSRALGDLTGIKKHYCRKHGEKKWKCDKCNKRYAVQSDWKAHSKTCGTREYRCDCGTLFSRRDSFITHRAFCDALAQESARVPPMGAGMYGTGGMALGLSGMATSQLQSFQDQTHSSATTAISSNPAAQFEHLMQSSTGSPVFRGAQPTSSSSSPFYLGGAEDGHQSLSGHTSLLHGNKQAYHGLMLLPEQQHQAGSNGLLNLGFFSGGSSGQDARLVFPDQFNGAVGGNVRGDGSEHGHSGANTESAAIFSGNLMGNHQMASSAGFSSSLYNSSETVAPAQMSATALLQKAAQMGATTSSGNVNSLLRGLGSSAGGTLNGRPAGAAAGFMAGEGSSSRSTSQAENESQFRDLMNTLAASGSGAAGTAFSGGFPGMDDSKLSTRDFLGVGGGVVRSMGGAAGLPLRHGAAGIGMGSLDTEMK

SEQ ID NO: 21734 - protein, 352 aa, Vitis vinifera
MKASLFRSAETALRRVSSPSASSHLLRRSYCVESKPERKVAVLGAAGGIGQPLALLMKLNPLVSSLSLYDIAGTPGVAADVSHINTRSQVAGYMGDDQLGQALEGADLVIIPAGVPRKPGMTRDDLFNINAGIVKSLCTAIAKYCPNALVNMISNPVNSTVPIAAEVFKKAGTYDEKKLFGVTTLDVVRAKTFYAGKAKVPVAEANVPVVGGHAGITILPLFSQATPKSNNLSDEDIVALTKRTQDGGTEVVEAKAGKGSATLSMAYAGAVFADACLKVLNGVPDVVECSFVQSTIVPDLPYFASKVKLGKNGVEEVLGLGPLSDYEKQGLESLKHELKASIEKGIKFATQS

SEQ ID NO: 21735 - protein, 429 aa, Bacillus cereus ATCC 14579
MLAKRIPIPVAEAVARVMKYAHQGETEEVSLIESYGRTLGEDVIADHDVPHFDRSPYDGFAIRSEDTKEASSSNPIQFEVIGEIGAGVVFTEEVKAFQAVRIMTGAAIPRGCNAVVMLELTEGFEKNEKTYMTLKRCFTAGDNISFKGEDVKQNTILVKEGTVINPGVAALLATFGYSTVYVIKQPVIGIVTTGSELLEVHEKLKPGKIRNSNSYMIAAQIERAGGIVQYYGQFADDFETCYNTVKKAIKEVDILITTGGVSVGDYDYLPAIYERLRANVLFDKIAMRPGSVTTVAEVEGKLLFGLSGNPSACYVGCELYVRPVIGKYLHREDSHIYRAEAILQKDFPKANPFTRFVRGRVEIVDGQLQVTPVGLDKSSAISSLAEANAFIVLPGGTRGFKAGITVSVLLLESNNGSEWPWEEPLRSYK

SEQ ID NO: 21736 - protein, 487 aa, Oceanobacillus iheyensis HTE831
MSNKRNTLTTASGAPVGDNQNSITAGHNGPTLLQDFHLLEKLAHFNRERIPERVVHAKGAGAHGYFEVTNDEISKYTKADFLSEKGKRTDMFIRFSTVAGEQGSADTVRDPRGFAVKFYTEEGNYDLVGNNTPIFFIRDAIKFPDFIHTQKRNPQTHLKDKDMVWDFWSLSPESLHQVTYLHSDRGLPATLRHMNGYGSHTFKWVNAEGEAFWVKYHFISEQGIKNLDPALADKIAGENPDYHTEDLFNAIEEGDHPAWKLYVQIMPYEDAKTYKWDPFDVTKIWSKKDYPRIEVGRMVLDRNPENYFAEVEQAAFSPGQFVPGIEASPDKMLQGRLFGYSDAHRYRLGANHHSIPVNRPKNEVNNYQRDGFMSVDGNGGNKPNYEPNSVNGPTEDSEAKINPFEIYGQADSVTYDSDDHYTQAGDLYRLMSADEKDRLVEAFVGHMTPVTKDEIKLRQIEHIYKADAEWGERVAQGLGLQVPESVK

SEQ ID NO: 21737 - protein, 454 aa, Hypnea cornuta
  unsure (1)..(454): unsure at all Xaa locations
GYWDPEYVIKDTDVLALFRVTPQPGVDPVEASAAVAGESSTATWTVVWTDLLTACDLYRAKAYKVDAVPNTSDQYFAFIAYDIDLFEEGSIANLTASIIGNVFGFKAVKALRLEDMRIPVAYLKTFQGPATGIVSERERMDKFGRPFLGATVKPKLGLSGKNYGRVVYEGLKGGLDFLKDDENINSQPFMRWKERFLYSMEGVNRSVAATGEVKGHYLNVTAATMEDMYERAEFAKQLGSIIIMIDLVIGYTAIQTMGIWARKNDXILHLHRAGNSTYXXQKIHGMNFRVICKWMRMAGVDHIHAGTVVGKLEGDPLMIKGFYNTLLLPYLKINLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADF

SEQ ID NO: 21738 - protein, 90 aa, Glycine max
  unsure (1)..(90): unsure at all Xaa locations
LNENPENYFAEVEQVAFNPAHLVPGIEPSADPVLQSRLFSYPDTHRHRIGVNYQQLPVNQPRVPYRMGNFQRDGSMAFYNQGARPXYLSS

SEQ ID NO: 21739 - protein, 228 aa, Tsuga mertensiana
NTGPEDVIIRVIYCGICHSDIFHTRNKMGLSHYPMVPGHEVVGIVTEIGSEVKKFKVGEHVGVGCIVGSCRICGNCNDSMEQYCKNMIWSYNDVNHDGTPTQGGFASTMVVDQMFVVRIPENLSLEQAAPLLCAGVTVYSPMKHFGMTEAGKRCGILGLGGLGHMGVKIAKAFGLHVTVISSSDKKKEEALEVLRADAYLVSKDAEKMQEAAESLDYILDTIPVAHPL

SEQ ID NO: 21740 - protein, 203 aa, Glycine max; identical to SEQ ID NO: 2850

SEQ ID NO: 21741 - protein, 370 aa, Anthurium andraeanum
MVPAATPFLPTTAEEATLRPSFIRDEDERPKVPHNQFSDAIPVLSLAGIDDSDGSPRRAELCREIVEACEGWGIFQVVDHGVDPGLVADMTRLATEFFALPPEDKLRYDMSGGKKGGFIVSSHLQGEAVQDWREIVTYFSYPVRARDYTRWPDKPEGWRAVVEAYSEGLMGLACKLLGVLSEAMGLDKEALAKACVDMDQKVVVNFYPRCPQPDLTLGVKRHTDPGTITLLLQDQVGGLQATRDGGKTWITVQPVEGAFVVNLGDHGHLLSNGRFKNADHQAVVNSERSRLSIATFQNPAPEGVVYPLAVREGEKPVLDEPISFSEMYRRKMSRDLELARLKKQAKLQQQDVLAKAEDANKHKALDEILA

SEQ ID NO: 21742 - protein, 534 aa, Zea mays
MALEPVALLLTVLVAAPLTVLLLLLFLVAGNKRPARAASPTPRHRLRLPLPPSPRGLPLLGHLHLLGSLPHRALASLARAHGPVLLLRLGRVPTVVVSSAAAAEEVMRARDLAFANRPASAMAVRLLYGRDVAFAPYGEYWRQARRVCVVHLLSARHVGSFRRVREQEAAALVARVARDSAGGAAVGLSDLLTEYANAVVSRAAFGDESARGLLGEFDSGRRQRKVLTDFQKLVGTTPVGELLPWLGWVDAVTGLEGKIRRTFEALDGLLEKVIDDHRRRPRSGEEGGDRDFVDVLLDVHNKDQEHGIQLETNEIKAIILDMFAAGTDTIATAMEWAMAELVTHPRAMRRAQDEVRAAAAGSTGVNEDHVAQLDYLKAVLKETLRLHAPLPLLVPREPAADTEILGYHVPARTRVLVNAWAIGRDPATWERAEEFVPERFLGGAAAADVGFKGQHFELLPFGGGRRMCPGIAFAEGSAEMALASLLYHFDWEAASRGQNGKGTLSLDMTEMNGLAVHINSGLPLVAKPWIPFKN

SEQ ID NO: 21743 - protein, 204 aa, Spinacia oleracea
MEEVATTMDFSPLTDAIASESYDKIADICDNLMLQVSAEGIVFQNDWPYAIHLLGHIYAGDINSARFLWKSIPIAIKESQPEIIAVWGIGQKLWTRDYAGVYEAVRSFNWSPQIHPFIAAFSDNNTKKMFQLLVAAYSTISVQDTALFLGMSEDEATTYVLQEGWILDSAARMLTVKKQTIVTEQKLDPSKLQRLTEYVFHLEH

SEQ ID NO: 21744 - protein, 186 aa, Xanthomonas axonopodis pv. citri str. 306
MTDCSRCAGTNTSGPNHWPERIRDIVDFPKPGIVFKDITPLLSDGPDFASALDEMAQPWRTTPLDAVLGIEARGFILGAALARELRTGFVPVRKPGKLPGRTLIQEYALEYGTDRIEMHEDALPRGARVLIVDDVLATGGTLRAALGLAAQLELEVVGAAVLVELQGLQGRQKWANDVPLLATLSY

SEQ ID NO: 21745 - protein, 358 aa, Oryza sativa
VYDGCQTWETAFIVQAICSTGLVDEFSTTLEKAYGFLKNSQVLHDLPNGKSFYRHRSKGSWTLSTADNGWSVPDCTGETLQALLGLSKISPKLVGDPIKEKSLYDAVDCLLSFSIALLEYRPLSDKVFFDSGKIMKKILNPSESFRNIVVDYPHVECTSSAIQGLISFTELYPGYRGVEIESCIKNAVMFIENKQQNDGSWYAKFNARYGTWGICFTYGAFFAIRGLIAAGRNYENSQAIRNGCKFLLSKQLSAGGWGEHYSSSEIEVYVDSGSPHAVNTSLAMLALLYSGQIERDPTPLYRAAKQLISMQLETGEFPQQEHVGCFNSSLYFNYPNYRNLYPIWALGEFWHRLVASKV

SEQ ID NO: 21746 - protein, 110 aa, Rhodospirillum rubrum
MTVRRPLIAGNWKMNGLKAEGQGLARDLAQRLNKAGGVDFDLLLCPPFPLISTVVGAVAGSGIAVGGQDCHAKAKGAHTGDVSAPMLADLGCQFVIVGHSERRADHGETD

SEQ ID NO: 21747 - protein, 253 aa, Oryza sativa (japonica cultivar-group); identical to SEQ ID NO: 7171

SEQ ID NO: 21748 - protein, 426 aa, Chlamydophila pneumoniae CWL029
MLPLIIFVLLCGFYTSWNIGANDVANAVGPSVGSGVLTLRQAVVIAAIFEFFGALLLGDRVAGTIESSIVSVTNPMIASGDYMYGMTAALLATGVWLQLASFFGWPVSTTHSIVGAVIGFGLVLGKGTIIYWNSVGIILISWILSPFMGGCVAYLIFSFIRRHIFYKNDPVLAMVRVAPFLAALVIMTLGTVMISGGVILKVSSTPWAVSGVLVCGLLSYIITFYYVHTKHCSYISDTPKKGSLTYRLKERGGNYGRKYLVVERIFAYLQIIVACFMAFAHGSNDVANAIAPVAGVLRQAYPASYTSYTLIRLMAFGGIGLVIGLAIWGWRVIETVGCKITELTPSRGFSVGMGSALTIALASILGLPISTTHVVVGAVLGIGLARGIRAINLNIIKDIVLSWFITLPAGALLSILFFFALRALFH

SEQ ID NO: 21749 - protein, 360 aa, Oceanobacillus iheyensis HTE831
MKQVLENIESQFEMFQILDENGKIVNKDDMPDLSDDELKEIMRRMVYTRILDQRSTALNRQGRLGFYAPTAGQEASQLGSQFALEKEDFILPGYRDVPQLIWQGLPLYQAFLFSKGHFHGNQYPDELRALSPQIIIGAQYVQTAGVALGIKKRGNKNVAITYTGDGGTSQGDFYEGINFAGAYKAPAIFVVQNNRFAISVPVEKQTNAKTLAQKAVAAGIEGIQVDGMDVLAVYAATKFARERAVNGEGPTLIETLTYRFGPHTLSGDDPTRYRTEDMDNEWEKKDPIVRFRTYLESKKLWSEEDENNAIEQAKEDIKKAIKQAEEQPKQKVTDLIANMYEELPTHLQEQNEIYKEKESK

SEQ ID NO: 21750 - protein, 238 aa, Oryza sativa (japonica cultivar-group); identical to SEQ ID NO: 9413

SEQ ID NO: 21751 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTDADPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 21752 - protein, 477 aa, Botryoglossum platycarpum
KNERYESGVIPYAKMGYWDPDYVIKETDVLALFRVSPQPGVDPVEASAAVAGESSTATWTVVWTDLLTACDLYRAKAYKVDAVPNTTDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEIKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIKGFYDTLLLPYLEVNLPLGIFFTQDWASLRKVTPVASGGIHCGQMHQLLDYLGNDVVLQFGGGTIGHPDGIQAGATANRVALESMVIARNEGIDYVTEGPQILRDAAKTCGPLQTALDLWKDITFNYTSTDTADFVATPTANV

SEQ ID NO: 21753 - protein, 198 aa, Agrobacterium tumefaciens str. C58
MIGWPELPDPFPILTGNTMTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 21754 - protein, 180 aa, Cicer arietinum
PKATNKNLLKNGGFEEGPYIFPNTSYGVIIPPNIEDNHSPLPGWMVESLKAVKYLDSSHFSVPEGTRAIELVAGKESAIAQVARTIPGKTYVLSFSVGDASNSCEGSMIVEAFAGRDTVKVPYQSKGKGGFKRAVLKFVAVGSRTRIMFLSTFYSMRTDDLSSLCGPVIDDVKLLSLRKP

SEQ ID NO: 21755 - protein, 198 aa, Zea mays; identical to SEQ ID NO: 4930

SEQ ID NO: 21756 - protein, 161 aa, Zea mays
  unsure (1)..(161): unsure at all Xaa locations
MGSEGSSGPVVVPRNFRLLEELERGEKGIGDGTVSYGMDDADDIYMRSWTGTIIGPPNTVHEGRIYQLKLFCDTDYPDKPPTVRFQTRINMTCVNQETGLVEPSLFPMLGXWEREHTMEDILSSLKREMSTPQNRRLYQPHEGNEDQRVEQKGISLRCVVM

SEQ ID NO: 21757 - protein, 664 aa, Eremothecium gossypii
MLKSVEKLTLPQVISQRLTFHYRLRRKPEEIEENCISSETSDEKHSKGCNDQKNASHYEQPVMVTDLRDDSEGFSIQETELERPAMRQSNKMSILVGIFVAVGGFLYGYDTGLINSITEMSFVKKHFAPNHVNFTSMEMSILVSFLSLGTFIGALAAPLLADSYGRKSTVIFSTFIMFLEGTLLQVSATSMALLVAGRVASGVAVGLISVVVPLYQGEAAQKWCRGAIICTYQWAITWGLLVSSAVSQGTYLRNDASSYRIPIALQYVWCIILGSGMLLLPESPRYYVLRDQLDKAALSLSFLRGVPHDDAGLLEELVEIKANYDYEMSLKSSSYLDCFRTSEHRPKQQIRMLSGILLQAFQQFSGINFIFYYGVNFFSSTGISKSYLVSFVTYAVNVVFNIPGLFLVEYAGRRKLLLVGGVLMTISNFIIAIVGVSTDSVIAKKVMIVFICMFIAAFSATWGGVVWVMSAEMYPLGVRSKCAAICAASNWLVNFVCAMITPYLIDISSYTSRLGSTIFFVWGSLNAIGVMVVYLTVYETSGLTLEEINELYRRCPSSLASCAWNRRIKSSPEDYHLTVTGRCAPSEHQDHVDLGNGLCLATYHRAPPSIISESSNSSSDSVVNSGAGAGGPAAAPAGINAYMSDLMNNIVVNTHSTPAAGTST

SEQ ID NO: 21758 - protein, 308 aa, Yersinia pestis CO92
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINLGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQMGRSIF

SEQ ID NO: 21759 - protein, 255 aa, Daucus carota subsp. sativus
MSFVDDQSGDLSLHERKSGRGKIEIKRIENTTNRQVTFCKRRNGLLKKAYELSVLCDAEVALIVFSNRGRLYEYANNSVRGTIERYKKANSDTPNTATVSEANTQYYQKEAARLRQQISNLQNSNRHLMGEALGAVPAKELKGLETKLQNGLSRVRSKKNELLFAEIEFMRKREIDLHNNNQYLRAKISENERAQQQMSLMPGASGSSEQYRDVGQPHESFDARNYLQVNGLQPNNANYSSHQDHQTQHVPLQLV

SEQ ID NO: 21760 - protein, 321 aa, Glycine max
  unsure (1)..(321): unsure at all Xaa locations
MSTAAAAGGDMEAGFAKLQGEDFEYYMQTYSIVLGRNSKKSTVDVDLSSLGGGMNISRHHARIFYXDFARRRFALEVLGKNGCLVEGVLHLPGNPPVKLDSQDLLQIGDKEFYFLLPVRSILVGPVGPRHYPNHAAPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTHEFVSLVSLLS

SEQ ID NO: 21761 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 21762 - protein, 306 aa, Triticum aestivum
  unsure (1)..(306): unsure at all Xaa locations
NSARGAKEDLRYPRSLLQNVIWTCLNKFVEPVLNCWPINKLRDTALKNLMKHIHYEDESTKYIGVCPINKALDMICCWIEDPNSDALKLHLPRIYDYLWLAEDGMKAQVYDGCQSWEPALIVQAYCSTDLVNELGPTLRKAHEFIKSSQVLENHPNSEAYYRHRSKGSWTLSTADNGWSVSDCTAEALKALLLLSKISPNLVGGPMKGERLHDAVDCLLSFMNKDGTFSTYECKRTTSXLEVLNPSETFLNIMVDYPSVECTSSVLEALIMFRELHPGYRNEEIGICIKNASMFIEDRQRKDGSWF

SEQ ID NO: 21763 - protein, 531 aa, Sorghum bicolor
MERGNNGGSGRPPSPPPTPVERKAAWAWRDGAVTYFHLLFYIAISGGQIFFNKASHAAPHLPTSRSPARSPPGLRPSSPDPPRPWVLSSKEINFPYPVALTLLHMVFSSVVCFAITKVFKYLPELVIFFLLYRSKFICVHAMLVRTHGFIRSLYISSVIPIGAMFAMTLWLGNSAYLYISVAFAQMLKAIMPVAVFLLGAAFGLEEMSYKMLSIMSVISVGVIVASVGEITISWVGVVYQMGGVVAEALRLIFIEIFLKKKGVKLNLISMMYYVSPCSAVCLFIPWLFLEKPKMDDSISWNFPPFTLFLNCLCTFILNMSVFLVISRTSALTARVTGVVRDWSVVLLSAAIFADTQLTFINIIGYAIAIAGVVAYNNHKLKVKPQANPQQDVYAASHDSQPKVPKRILKSSRMEEPDCPEGSVSDRGGERQTASLPLPDAFLEFLSENGLDPAVYSMAATIPRYIRELDLVFFLIPRLKPGMESQITEIESELKCVLEKVSWLPGFYAIPPEIQIAGSKAYQQGKARGIHI

SEQ ID NO: 21764 - protein, 278 aa, Glycine max
MEPRFVISASEAESQSISKLLPSLVSSSQSLARPSISNFPVAAVGLAASGRIFVGVNVEFPGLPFHHTIHAEQFLLTNMANNAETRLDSFAVSAAPCGHCRQFLQELRDAPDIQILITSHKNPHFSPLSHFLSHHFGPHDLLPKTVPLLLEPRHNALSLPQNDHFNALAIAALEAANNSHAPYSASPSGVALLDSKGNVFKGSYIESAAYNPSLGPLQAAIVAFIAGGGGDYEEIVAAVLVEKEGAVIKQDHTARLLLHSIAPRCHFNNFLASQSPST

SEQ ID NO: 21765 - protein, 335 aa, Rhodobacter sphaeroides
MARIAINGLGRMGKLLLRELIDRGMGDGIMLLNDAEGDPAQHALLMEFDSVHGRWTTPVTHDAESLTLAGHRIPLRRERRIEDLPLGELGVDLVVDCTGVFKTAAKIAPYFEAVKKVVVSAPVKDGGALNLVYGINHQLYDGSQRLVTAASCTTNCLAPVVKVIHERLGIRHGSITTIHDVTNTQTIVDRPAKNMRRARSALANLIPTSTGSATAIGLIYPELKGRLNGHAVRVPLLNASLTDCVFEVERPTTAEEVNALFAEAAAGPLKGILGYEERPLVSSDFLNDPRSAVVDAASTMVVGGTQVKIYAWYDNEWGYACRMADITRLVAESLT

SEQ ID NO: 21766 - protein, 384 aa, Solanum tuberosum
MGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 21767 - protein, 581 aa, Solanum tuberosum
MTSSYSLSSIRNSTKFVANNSNLFFPRQRLCVFTNETQFPKKDFLVLKPQTCSFSFLRLKKSSFTHPFAALSSFAESDDEKGENFEVKSHQEKAISSENEDELPGMAQAFNISSSTASAVAICIALAALILPFFMKSLGQGLGLKYKILSYVTILFGFYMAWNIGANDVANAMGTSVGSGALSLRQAVVMAGVLEFSGALLMGTHVTNTMQKGILVTNVFQGKDTLLFAGLLSSLAAAGTWLQVASYYGLPVSTTHCIVGSMVGFGLVYGGTGAVFWSSLARVISSWVISPLLGAVVSFLVYKCIRRFVYSARNPGKAAATAAPISVFLGVTGISFIALPLSKTLNLALGQAITCGAISAFAVDRIIRGQLGHLLARASSKEPEPEPETTDTKNIGFLSDIAGPKGTQLKIVYGVFGYMQVLSACFMSFAHGGNDVSNAIGPLASALSILQGGLSAADIVIPNDVLAWGGFGIVAGLTMWGYRVIATIGKKITELTPTRGFAAEFAAASVVLCASKLGLPISGTHTLVGAVMGVGFARGFNSVRAETVREIATSWAVTIPAGATFAVIYTWIFTKLLSYLL

SEQ ID NO: 21768 - protein, 318 aa, Zea mays
MKPPASSTATSYLLLAPLAILLLVFVLPSLRPWSRVGSDSDGLGILCARRTGGFVDVAADAPAPPPGQTTRAAEFSLLVGVLTVPGRRERRDIVRTAYALQPAAEGARVDVRFVFCRVTDPVDAALLAVEARRHGDVLVLDGCAENMNDGKTYAYLSSVPRLFAAEPYDYVMKADDDTYLRVAALAGELRGKPRHDVYLGYGYAMGGQPMPFMHGMGYVVSWDVAAWVAGAREILERNDTLGPEDLMVGKWLNLAGRGRNRYDLKPRMYDLSWDMDNFRPDTVAVHTLKTNRRWAAAFRYFNVVTAGITPSSELYHLP

SEQ ID NO: 21769 - protein, 96 aa, Glycine max
  unsure (1)..(96): unsure at all Xaa locations
PEYGVHLGLAANNNSPSRSNPQAHAENLICXGANTHSNAQNTAGVITMAREGVRDFDTPTKELSPILACKPGLNIRGETNLASGIQAAQQAIKSLR

SEQ ID NO: 21770 - protein, 442 aa, Lactobacillus plantarum WCFS1 [sequence omitted]

SEQ ID NO: 21771 - protein, 168 aa, Oryza sativa (indica cultivar-group)
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 21772 - protein, 196 aa, Mitthyridium sp. Wall 2439
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTSDVSVVDLTVRLEKPASYDAIKAALKEASQGKMKGILGYTEDDVVSSDFITDSQSSIFDAKAGIALSDTFVKL

SEQ ID NO: 21773 - protein, 517 aa, Phaseolus vulgaris
MTKLLHSYFSIPFSPFYVSIPIATVLFVLIIYNFFLASKNHSSTPPGPLSVPIFGNWLKVGNDLNHRVLTSMSQTYGPVFLLKLGSKNLVVVSDPELATQVLHSQGVEFGSRPRNVVFDIFTGKGQKMVFTVYGEHWRTMRTIMNLPFFTKKGVHNYSTMWEEEMELVVRDLKVNEHVRSEGIVIRKRLQLMLYNIMYRMMFDAKFESQEDPLFIQATRFNSERSRLAQSFEYNYGDFIPLLRPFLRGYLNKCKDLQSRRLAFFNTHYVQKRRQIMAANGEKHKISCAIDHIIDAQMKGEISEENVIYIVENINVAAIETTLWSMEWAIAELVNHPSVQSKIRDEISEVLKGEPVTESNLHELPYLQATVKETLRLHTPILLLVPHMNLEEAKLGGYTVPKESKVVVNAWWLANNPSWWKNPEEFRPERFLEEECATDAVAGGKVDFRFVPFGVGRRSCPGIILALPILGLVIAKMVSNFELSAPQGTKIDVNEKGGQFSLHIANYSTVLFHPIRTQ

SEQ ID NO: 21774 - protein, 94 aa, Zea mays
SWCTFFQVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 21775 - protein, 356 aa, Streptomyces sp.
MTAEPTVAARPQQIDALRTLIRLGSLHTPMVVRTAATLRLVDHILAGARTVKALAARTDTRPEALLRLIRHLVAIGLLEEDAPGEFAPTEVGKLLADDHPAAQRAWHDLTQAVARADISFTRLPEAIRSGRPTYESVYGKPFYEDLAGRPDLRASFDSLLACDQDVAFDAPAAAHDWTNVRHVLDVGGGKGGFAAAIARRAPHVSATVLEMAGTVDTARSYLRDAGLSDRVDVVEGDFFEPLPRRADAIILSFVLLNWPDHDAVRILTRCAEALEPGGRILIHERDDLHENSFNEQFTELDLRMLVFLGGALRTREKWDGLAASAGLVVEEVRQLPSPTIPYDLSLLVLAPASTGA

SEQ ID NO: 21776 - protein, 493 aa, Glycine max
  unsure (1)..(493): unsure at all Xaa locations
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEXRVPVPPRILGGKREKCMIEKENNFKQPGERYRSWPSDRQERFVRRWVDALSDPRVTHEIRSIWISYWSQADRSLGQKIASHLNLKPSI

SEQ ID NO: 21777 - protein, 210 aa, Triticum aestivum
  unsure (1)..(210): unsure at all Xaa locations
VPRQQWEECYDGHGYPPGGQGGYSPQGYPPQQGGYPPQQGYPPAPGAYPPAPGAYPPAPGAYPPAPGAGGSDGEKGLLSNIMHGXPGLHGGGHGYPSGGHGYPPQQHGYPQQGYPPQHGYPPQQDGYPPQQHGYPPAGYPGSSGHSGSHGRRRHWAWAACLAGGASAAGGAYGATKFSRGTRGRWTTLAGMRSAQRVGRAHRPSGESKNT

SEQ ID NO: 21778 - protein, 187 aa, Triticum aestivum
MLAQRVGVNALRSGAAKPFFAQNISKSALAAGISTSSPTRATGSVKVSQEDGHQILVNQRLNRPVSPHLAIYKLEQTWFGSSAWNRITGCTLSATLYGFSIAYLAAPVVGLHLESLSIASFVAGLPLAVKGGLKFTLGFPFVYHAISGVKHLLYDAGKGFAKSTIIQADKYVWAASVLGAIGLVAFL

SEQ ID NO: 21779 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNGARFEFRFPDSSSNPYLAFAAILMAGMDGVKNKIDPGEAMDINLFKLTLDEIREKGIKQMPHTLRRSLEEMLADKQYLKEGQ

SEQ ID NO: 21780 - protein, 332 aa, Vibrio fischeri
THAPGRHGGRGNSIGFGRIGRSVLRALYESDKRDKIEVVAVNELSQPEAMAHLFQYDSTHGRFQHKVTHDQEYLYIDLPDSSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVDGSQTRVSNGHLVKMLVWYDNEFG

SEQ ID NO: 21781 - protein, 850 aa, Trichodesmium erythraeum IMS101
MQEVQPEKPYTEKVKIQIEDDRTGTSLDTIKRAIADNLYYLQGKNIEFATPYDYYMALAYTVRDRLLHRHLQTTKTYSNQNVKTVYYLSAEFLMGRQLAKNLVNVGCWEVARQALEESCLQLHDLIEKEPEPGLGNGGLGRLAACFLDSLATLQIPAVGYGIRYEFGIFKQLVHNGFQVEQPDKWLSLGNPWEIPRYEEKVEIKLGGDTETYTDKEGNYRVRWIPERTVIGMPYDTLVPGYNTNTVNNLRLWSAKASNEFDLQVFDSGDYNRAVEDKTVSENISKVLYPNDNIFQGKMLRLEQQYFFVSCSLQDIIRTHLSRNRNLDNFHKKVAIQLNDTHPSIGVAELMRLLIDEHKMEWEKAWKITQNTFGYTNHTLLAEALERWPVSMFKSLLPRHIEIIYEINFHLLEELKKRYPGDDRRLARMSLIEEQPEKSVRMAHLACTGAHAINGVAKLHTQLLKTDVLKDFYKLWPEKFTNKTNGITPRRWLLISNPKLALLITNKIGKNWINNLEEIQQLKQFVNDQEFRYNWSQIKYENKQDLATYIKQNIGVVVNPNSLFDIQVKRLHEYKRQLLNVFHIITLYNRIKENPDTDILHRTFIFGAKAAPGYSMAKLIIKLINAVAEIVNNDPDVRHRLKIVFIPNFSVSLGQQIYPAADLSEQISTAGKEASGTGNMKFSLNGALTIGTLDGANIEIREAVGADNFFLFGLTVEEVKALKYQGYNPQKYYNDNKELRQVIDRIASGYFSPGKPDLFQPLIVSLLEKDEYMLLADYQSYIDCQEEVNKAYRNPEYWTRMSIINSINMGKFSADRTISEYCQEIWNVDPVKIDMEAYNQETAGLQRHCQI

SEQ ID NO: 21782 - protein, 151 aa, Catharanthus roseus
MEVGQLQRSFVEFTESLFREGFLDAQFCQLQQLQDENNPDFVIEVVSLFFEDSEKLLNDLTRALDQQDVDFKKVDACVHQLKGSSSSIGAERVKNACIAFRNFCDELNIDACLRCLQHVKQEYLLVKNKLETLFRLEQQILAAGGAIPMVE

SEQ ID NO: 21783 - protein, 218 aa, Burkholderia fungorum
MTTATPENSGKQTRNHPDEIVIGLVSISDRASTGVYEDKGIPALQEWLGAALSSPWQVVTRLIQDDAPTISATLTELVDEVGCDLVLTTGGTGPSRRDVTPEATLAVATKEMPGFGEQMRQISLNFVPTAILSRQVAVIRETAEHAALIINLPGQPKSIRETLEGLRDAEAGGAVKVPGIFAAVPYCIDLIGGPYVETNANVVKAFRPKNAQRAPRPA

SEQ ID NO: 21784 - protein, 617 aa, Novosphingobium aromaticivorans
MSAERWLPMRRISLISALALVLSLGQPALADVPLAEVRARPAAGEVVYFLLPDRFDNGDRKNDLGGLKGDRLKTGFDPSAKGFYHGGDIKGLLSRLDYLQDMGVTALWVAPVFRNKPVQGAPGQESAGYHGYWVTDFTRIDPHFGSNADFKALVDAAHARGIKVYMDIIANHTADVIHYADGDYSYRNRADWPYSRKGGLSGKAINQGFAGDEDSSAANFAKLTDPGAAYQPLIDPAERNVKVPAWLNDPIYYHNRGNTTFTGEDSRFGDFAGLDDLFTEHPRVRAGMVEIYADWIRRFGIDGYRVDTAKHVDPGFWQVFTPEIRKVAAEAGIPNFAVFAEIANGGSDPGTIARHTRRDGFPQVLDFAFQEAVRDLVGKGKATRVLAETFDGDVLYEGGEAAALAMPTFLGNHDMGRFSTAVRQDRPGISDKELLDRVALAHVMLMTLRGSPVIYYGDEQGFVGDGGDQDAREDMFPSRTASYNDNRLIGTASTTAADNFDEGHPLYRLIRDLAVLRKAHPALARGRQVTRTYSEGPGLFSVSRFDPETGTEYLIAFNTSDKPLRATSVIGASASGLEGLYGQCPLSVAAPGSVLLDLPAFGSVVCRVILSPESSVR

SEQ ID NO: 21785 - protein, 427 aa, Ipomoea batatas
LGGGAGTRLYPLTKKRAKPAVPLGANYRLIDIPVSNCLNSNVSKIYVITQFNSAYLNRHLSRAYASNMGGYKNEGFVEVLAAQQSPENLWSQGTADAVRQYLWLFEEHNVLVLEFLVLAGDHLYRMDYERFIQAHRETDADITVAALPMDEKRATAFGLMKIDEEGRIIEFAEKPKREQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPISTTPRYLPPSKMLDADVTDSVIGEGCVIKNCKIHHSVVGLRSCISEGAIIEDSLLMGADYYETDADRRLLAAKGSVPIGIGRNSHIKRAIIHNIARIGNDVKIINNDNVQEAARETEGYFIKSGIVTIIKDALIPSGTII

SEQ ID NO: 21786 - protein, 468 aa, Leuconostoc mesenteroides subsp. mesenteroides ATCC 8293
MSYQTINPFNDEVIQTFDNHDDAYVEKAIAEGHALYKKWRNDPASSRAEILNKIADLMEEDADHLAKVLTIEMGKRFVEAQGEVALSVSIARYYAKNGADFLKPEPIKSSMGDAQVISRPTGVLMMVEPWNFPYYQIIRVFAPNYIAGNPMLLKHASNTPMAASEFEKIVERAGAPTGAFANLFIDYDQVNKIIADDRVQGVALTGSERAGQLIAAEAGKNMKQSSLELGGSDPFIVLEDADLSEIKKIIGGARLYNAGQVCTSSKRFIVTEKNYDAVLTMLKDAFAEAKLGDPLLEDTTLAPLSTSKAKKNLTKQVKAAVDAGATLEYGSVVQDKPAALFDPVILTGITKDNPAYYQEFFGPVGQVYKVKDEEEAITLANDSNYGLSGVVFGGSPEHATEVASRIETGAVYVNSFGGTLPELPFGGVKNSGYGRELGRFGIETFVNKELIVTKKEPIDLDNAFGGFV

SEQ ID NO: 21787 - protein, 497 aa, Oryza sativa
  unsure (1)..(497): unsure at all Xaa locations
MPEKAVDDVMDSAVGAHFSGLRLEALRLSSPSAPSSPSSAKAAAAAAAHSNGAVYANGVAADAAELVSPSALRQPFVIGVSGGTASGKTTVCDMIIQQLHDHRVVLVNQDSFYRGLTAEESAHAQDYNFDHPDAFDTEQLLECMGQLKRAQPVNVPIYDFKNHRRSSESFRKVNASDVIILEGILVFHXDQRVRNLMDMKIFVDTDADIRLARRIRRDTVERGRDVSSVLEQYGRFVKPAFDDFVLPSKKYADVIIPRGGDNHVAIDLIVQHIRTKLGQHDLCKIYPHVYVVQTTFQIRGMHTLIRDRDITTPDFVFYSDRLIRLVVEHGLGHLPFTEKQIITPTGSIYMGVEFCKKLCGVSIVRSGESMENALRACCKGIKIGKILIHRVGDNGQQLIYHKLPMDIAERHVLLLDPVLGTGNSANQAIELLIRKGVPEERIIFLNLISAPEGIQCVCKRFPRLKIVTSEIDTGLSEEYRVIPGLGEYGDRYFGTDN

SEQ ID NO: 21788 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNLAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 21789 - protein, 469 aa, Brucella melitensis 16M
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEFRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 21790 - protein, 323 aa, Zea mays
  unsure (1)..(323): unsure at all Xaa locations
MGILALITGKAGASGFGSASTAEQVTDGADASRLTVAITGGASXGIGLETSRVFALRGAHVVIAARNTEAASEARKTIMEKNPTARIDVLKLDLSSLKSVRAFVDQFNSMKLPLNILINNAXGVMFCPFQLSKDGVEMQFATNHLGHFLLTNLLLDTMKATAKSTGIEGRIVNLSSVAHHHTYPKGIDFDNLNDEKIYNDKMAYGQSKLANLLHAKELSRRLKEEGANITVNSVHPGLIMTNLMRHSXFVLMKVLQVATYILWKNVPQGAATTCYVGLSPQLKGVTGKYFADCNVEKTSKLARSEELAKQLWDFSEELIKSAK

SEQ ID NO: 21791 - protein, 396 aa, Gossypium hirsutum
MALNFNAIASKSQKLPCFALPPKATLRSPKFSMISTIPSGSKEVGNLKKPFTPPKEVPVQITHSMPPHKIEIFKSLEGWAENNILTHLKPVEKCWQPADFLPDPNSDGFHEQVKELRERAKEIPDDYFVVLVGDMITEEALSTYQTMLNTLDGTRDETGASLTPWAIWTRAWTAEENRHGDLLNKYLYLSGRVDMRQIERTIQYLIGSGMDPHTENSPYRGFIYTSFQERATFISHGNTGRLAKEYGDINLAQICGSIASDEKRHETAYTKIVEKLFEIDPDETVLAFADMMKKKIAMPAEFIYDGRDYNLFDHYSAVAQRIGVYTAKDYVDIVEHLVDRWKVKELAGLSAEGRKAQDYLCSLPSRIRRLEERAQEKAKEAPSVPFSWIFDREVKL

SEQ ID NO: 21792 - protein, 336 aa, Listeria monocytogenes EGD-e
MTVKVGINGFGRIGRLAFRRIQNVEGIEVVAINDLTDAKMLAHLLKYDTTQGRFDGEVEVHDGFFKVNGKEVKVLANRNPEELPWGDLGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPTLKGKLDGAAQRVPVPTGSLTELVTVLDKKVTVDEVNAAMEAASDPETFGYTSDQVVSSDIKGMTFGSLFDETQTKVLTVGDQQLVKTVAWYDNEMSYTAQLVRTLEYFAKIAK

SEQ ID NO: 21793 - protein, 355 aa, Secale cereale
MPSSQAQADLWRHTLYYLTSMGLRCAVKLGIPTAIHNLGGVSSLPDLAAALSIPASKQPFLGRLMRALVTSGVFANGKERLLGGLFRLNPLSRILVEGVVAEEHHSQTSFVLAGTSRHYMEAALGMADWFKKDATGPVPTVFEDVHSASLFDESTAALDPELDALVTEGLAAHDNLGIGTIIREFHDLFKGLVSLTDFCCGDGTTSRAITKAHPHVKFTVLDLPKVIDKTPSDGIVNYFAGDLFHTVPKAQAVMLKLVLHHLSYEDCFKILTQCKDAIPSREEGGKVIVIDIVVAPSLGQVMFKEQTLMDILMLVFTRGRQRSENNWHELFTKAGFSDYKIVKKLGARGVIEVYK

SEQ ID NO: 21794 - protein, 243 aa, Zea mays; identical to SEQ ID NO: 17703

SEQ ID NO: 21795 - protein, 668 aa, Camelina microcarpa
MAAATTTSSSSIPFSTKHSSSKSPLPISRFTLPFSLNPNKSSSSSSRRRGIKSTALSISAVLNTTTNVSTTTPQSKPTKPEKKKFVSRFAPGQPRKGADILVEALERQGVETVFAYPGGASMEIHQALTRSSSIRNVLPRHEQGGVFAAEGYARSTGKPGICIATSGPGATNLVSGLADALLDSVPLVAITGQVPRRMIGTDAFQETPIVEVTRSITKHNYLVMDVEDIPRIVEEAFFLATSGRPGPVLVDVPKDIQQQLAIPNWEQSMRLPGYMSRMPKPPEDSHLEQTVRLISESKKPVLYVGGGCLNSSEELGRFVELTGIPVASTLMGLGAYPCDDELSLHMLGMHGTVYANYSVEHSDLLLAFGVRFDDRVTGKLEAFASRAKIVHIDIDSAEIGKNKTPHVSVCGDVKLALQGMNKVLENRAEELKLDFGVWRSELNEQKQKFPLSFKTFGEAIPPQYAIQVLDELTDGRAIISTGVGQHQMWAAQFYKYKKPRQWLSSAGLGAMGFGLPAAIGASVANPDSIVVDIDGDGSFIMNVQELATIRVENLPVKILILNNQHLGMVMQWEDRFYKANRAHTYLGNPAEEDEIFPNMLQFASACGIPAARVTKIAELREAIQKMLDTPGPYLLDVICPHQEHVLPMIPSGGTFNDVITEGDGRTKY

SEQ ID NO: 21796 - protein, 278 aa, Cetraria sepincola
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSNTGAAKAVGKVIPSLNGKLTGMSMRVPTSNVSVVDLTCRLEKSVTYDQIKATMKKASEGELKGIMSYSEDALVSTDLNGDNHSCIFDATAG

SEQ ID NO: 21797 - protein, 403 aa, Triticum aestivum
  unsure (1)..(403): unsure at all Xaa locations
MASPMLSTAMAPLQGGMLEFSGLRSSSSLPLRRNATSDDFMSAVSFRTYAVSTSGGSRKAPTEAKLKVAINGFGRIGRNFLRCWHGRGDSSPLEVIAINDTGGVKQASHLLKYDSTLGIFDADVKPVGDNAISVDGKVIKVVSDRNPSNLPWGEMGIDLVIEGTXGVFVDRAGAGKHLEAXAPKKVLITAPGKGXIPTYVCGVNADLYTHADTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTLAEEVNQAFRDAAANELKGILDVCDEPLVSVDFRCSDVSSTIDASLSMVMGDDMVKVIAWYDNEWGYSQRVVDLADIVANQWK

SEQ ID NO: 21798 - protein, 557 aa, Glycine max
  unsure (1)..(557): unsure at all Xaa locations
LELEPNRLELSSSSLKRAFALFFRPFRIKYLFHFLSKQEKCSSESFKVESPNVKYTETEIQSVYNYETTELVHENKNGTYQWVVKPKTVKYEFKTNTHVPKLGVMLVGWGXGNNGSTLTGGVIANREGISWATKDKIQQANYFGSLTQASAIRVGSFQGEEIYAPFKSLLPMVNPDDVVFGGWDISHLNLADAMARAKXVFDIDLQKQLRPYMESMVPLPGIYDPDFIAANQGDRANNVIKGTKKEQVQQIIKDIKEFKESTKVDKVVVLWTANTERYSNLVVGLNDTMENLFASLDRNEAFCXISPSTLYAIACVMENVPFINGSPQNTFVPGLIDLAIKRNSLIGGDDFKSGQTKMKSVLVDFLVGAGIKPTSIVSYNHLGNNDGMNLSAPQTFRSKEISKSNVVDDMVNSNAILYEPGEHPDHVVVIKYVPYVGDXKRAMDEYTSEIFMGGKNTIVLHNTCEDSLLAAPIILDLVLLAELSTRIEFKAENEGKXFHSFHPVXATILSYLTKAPLVPPGTPXVNALSKQRAXMLENILRACVGLAPENNMILEYK

SEQ ID NO: 21799 - protein, 72 aa, Glycine max
MKFRYAMVCSSNQNRSMEAHFLLKRQGFDVSSYGTGAHVKLPGPSLREPNVYDFGTPYKHMIEDLRRKDPYF

SEQ ID NO: 21800 - protein, 302 aa, Escherichia coli
MTNLKAVIPVAGLGMHMLPATKAIPKEMLPIPVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFLKGIEKLLSEVTNS

SEQ ID NO: 21801 - protein, 333 aa, Zea mays
  unsure (1)..(333): unsure at all Xaa locations
MALEAVVFSQPQAGHFGCGRGDSPYAVPWSDLLQGGGGGGGGFGDVCAAGEWVDQHDLDTCWAAPTVGDDWDXGRRSRGDHSSSDAASTDHGSRKAAPEPAAGRRKRRRTKVVKNKEEIESQRITHIAVERNRRRQMNEYLAVLRSLMPPSHAHRGDQASIVGGAINYVRELEQLLQSLEVQKSLKQSRERRPAAGGASCSPPFAGFFSFPQYSTASSTTSSSGGEKCRGHDVAAADIEVTMVEGHASLKVLARRRPKQLLKLVAGLHQLRVPPLHLNVTAAVDAMVLYTFSLKVEDDSKMGSVEDIATAVHEILGSIQRQQQEEEEEETAAM

SEQ ID NO: 21802 - protein, 292 aa, Chloroflexus aurantiacus
MRQVTMEQIMQGKTVIVTGANSGIGYVTARELAAMGARVIMVCRSQSKGEAARQRIMQEAKGAPEPELVLADFASLASVRRAAGDILERCPRIDVLVNNAGLFVSEPLASADGYEMTFAVNHLAPFLLTNLLLERIIASAPARIINVSSFAHVAGRIAIPQIASPQRPNIAQAYSDSKLCNILFTNELARRLQGSGVTANSLHPGAVATNFAADSRGLFAFFFRLARPFMLSPEHGAATSIYLASSPEVAEISGQYFVRKKPVKPSAAAQGAALAKRLWEFSEQLVREKVAA

SEQ ID NO: 21803 - protein, 1106 aa, Neurospora crassa
MVDMLGTNANVLQSRDPISEFLQLLQDPFAAQLSSNSIYAALGSSVSITVAVALGFSLVRPLNTVVYAPKLKHADDKHAPPQLGKGFFSWIKPLWTTTEQDLVRLVGMDATIFMRFTRMCRNIFLCLAVLCCCIQIPINWYKNAAPESPWLQKVTPMNVWNQWQWATVVMSWVTTLIVCFFLWWNYRKVCELRIQYLRSEEYQQSLHARTLMLYDIPKNLTSDEGIARIIDSVAPSSSFSRTAVARDVKILPTLIEEHEKTVRKLEQVLAKYLKDPKNLPVTRPVCRPSKKDPSFSTYPKDKKLDAIDYLTQRIKLLELEIKEVRQRIDKRGSMPYGFASYSDISEAHAIAYLCRSKKPQGARVTLAPKPNDIVWENMPLSSASRATRRLWNNLWITVLTVVWVAPNAMIAIFLVNLSNLARVWPDFQKSLETNRNFWAIVQGIASPALTSLVYMVLPIIFRRLSMKAGDMTKTGRERHVVAKLYSFFVFNNLFVFSLFSALWSFGATVIKNTATDDDAWQAILDADFGTTVFVSLCGISPFWVVWLIQRQLGAAIDLSQLWKLIYGSIMRKFTNPTPRELIELTAPPPFDYASYYNYFLFYATAALCYAPIMPLVLPAAGMYFAIDVALKKYLLMYVFVTKTESGGMFWRILFNRILFGLMLSHLIVFLVVWVRGFGYKTQAYAVVPLPILIIIFKFVCSWIYDNKITYFSTRIIKHRNAEEGFGLKEQGPRNDRLASRFGHPALYKPLITPMVHAKAQNILASVYQGRLSDGRDAGLGDSMSVSGYSDTYALDSMASGKVGKLSSAVPGFEVVPESRLDFEFYKNRDEFAADHGAGELFGRASDIVRPDTPGTMATGSDNNSRPGTPVGGMGFSHNRRFFSNQSDMGNTAYVGGYMSPSQQYSSNNQAPYSPPILGPSEVPGRGRSPLYHMGDNGNDSSSNLVYNAAGMPTSTPAGFEVADDGLHRERSFDSTRSRGALGGFSIPNPRAPGVLGASRYGYGNVPQTDDDMMQTPPNAIQSSHFQPNQGQNDPMQYDYFRGNRRQGPPPGAPGRGKPRRTVNEVVELSTLNKGKKRDILRFWVRKTTAESEHERLASSAPGDEEN

SEQ ID NO: 21804 - protein, 419 aa, Grateloupia imbricata
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTC

SEQ ID NO: 21805 - protein, 355 aa, Arabidopsis thaliana
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 21806 - protein, 412 aa, Oryza sativa (japonica cultivar-group)
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLAGKSTNHPSPSSCSRLRFYFYLHTCSFCFFSSAAAAAADDDDLVVGGDGGGGGGGGLPHCKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFHPQNAAALYMDGPFMADGMYRLGS

SEQ ID NO: 21807 - protein, 485 aa, Gymnogongrus crenulatus
NSVERTRIKNERYESGVIPYAKMGYWDPDYVVKDTDVLALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSIAASGEVKGHYLNVTAATMEDMYERAEFAKQLGSIIIMIGLVIGYSAIQTMAIWARANDMILHLHRAGNSTYSRQKIHGMNFRVICKWMRMAGVDHIHAGTVVGKLEGDPLMIRGFYNTLLLPYLKVNLPQGIFFEQDWASLRKVTPVASGGIHCGQMHQLLDYLGDDVVLQFGGGTIGHPDGIQAGATANRVALESMVIARNEGRDYVAEGPQILQDAAKTCGPLQTALDLWKDITFNYTSTDTADFVETPTANV

SEQ ID NO: 21808 - protein, 208 aa, Streptococcus pyogenes M1 GAS
MLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 21809 - protein, 496 aa, Ralstonia metallidurans
MQDQSDQTRALWVDGVSVFTPARTFDSVNPATGEVNWQVAFATAEHVAAAVASAKRAVNDPAWRKMLPHVRAGILMRIADAMTARADEFARLQMLENGKVWSECRAQALSAASTFRFYASACETLGSEVTPSRGNYLSMTAYEPYGVVAAITPWNSPLTMEAQKVAPALAAGNAVILKPSEVTPSGALLLAQVAFEAGLPKGLLNVVTGDGRETGTALVEHPDVRMVSFTGGTATGRSIAGIAAQRLIPVALELGGKSPHIIFEDANIDAAINGVVDGIFEGSGQSCVAGSRLFVQRSIYDKAVGLLVERARALRVGLPDVAGSQLGPLAGFAHRDRVERFVSIAREEGGQILAGGRRPPEAALQAGAFFEPTVIGGLSNSATAVQQEIFGPVLCVLPFGDEDDLIAQANDSAFGLASGIWTANYQRAWRVARALETGLVWINTYKQLSIATPFGGFKDSGIGREKGVNGVRLYQQSKGIYWSMDEKNFPSDGALA

SEQ ID NO: 21810 - protein, 592 aa, Leptospira interrogans serovar lai str. 56601
MKIRFLLTVAFLLSLWTLRGRIIMSAESRRVTGARLMVELLEEYGVDVVFGYPGGAILPFYDEIYKSKKIKHILVRHEQGAVHMAEGYARATGKLGVCIATSGPGATNLVTGITDAKMDSVPILAITGQVATNAIGTDAFQEADIFGITIPITKYNALIKSADDIARHFEEATLIALGGRPGPVLLDFPKDVQTELTNVRKSSRLKIAPHHYKKPAVSGNLEEFAEAINRSQKPLLYVGGGAINAGASKEILELATKGGIPVTTTLMGLGAFPGTHPLSIGMLGMHGTATANKAVLECDYILNLGARFDDRVAKIGEFAEGAVRAHIDIDTAEFNKRIQVDYLLHGDLKDALSAILPFVKKQERKEWLTHLQNLKKEHPLDFDNSGNEIKPQDFLERLYKKTQGKAIVSTDVGQHQMWAAQYYLMDEPNNWLTSGGLGTMGYGLPAAIGAKFGRPDKTTICISGDGSIQMNIQELATIVANKLGVKILVFNNNFLGMVRQWQELFYEERFSESEWNFNPDFVKLAEAYSIPAMKISNKSEIDKAIEFFTKDDGAAFLEVMIPAEEKVFPMIPAGKSQKEMIEFKDLAGLKKV

SEQ ID NO: 21811 - protein, 683 aa, Arabidopsis thaliana
MHGRPRNASKPEEEAASAAKAVQLRSLQSQFMTNHHDKIYTNEAIELSTKLLEINPEAYTAWNYRKLAVEDRLARIEPDPNLVSAILDEELRVVESALRQNFKSYGAWHHRKWVLSKGHSSVGNELRLLEKFQKLDSRNFHAWNYRRFVVELTNRSEQDELQYTDDMINNNFSNYSAWHNRSVLLSSLLAQNADGFMPNIKIPEEYDFVHSAIFTEPDDQSGWFYHLWLLDQTLNVETPLLTSSWPSHGSSIILSGAGCLSGSSSMFTTFCSESGSFPLILYFDQAVGGVSSSTVTIDSELKGNEGLVWEPIPNKNSQVSCVWVARLKYVSSDPCEYKVKIRVGNSPGIVSSRGYNFNAPYEFVFTAHVHDTVEDSQEGIVSWTDGFDIWDAKSKDLNSLVTLDRLNAEMDFKWRQEAIDSEVECFGILPDSKIGKLTLARLLMAREAMVSDDAVKGVHYEEILQLYNDLMALDSSHYQYYKDEHSKAFLHKRMFMQVTSSSESLSRHLLRYRDMNNLVCLRLNNLSLSRIASVEKLLFVQMLDLSHNELHSTEGLEAMQLLSCLNLSHNRIRSFSALDSLRHVKQLKVLDVSHNHIGKHSVDTTRYLCSSPLSNSELGQDDVGKQNPGLVTKYWDAYCVLTDLNLKQLDIAGNEIAGEEFSSFVLQVVPKLVWLDGQKKLGN

SEQ ID NO: 21812 - protein, 336 aa, Enterococcus faecalis V583
MTVKVGINGFGRIGRLAFRRIKEVSDDIEVVAINDLTSPTMLAHLLQFDSTHGTYPGTVTATENGIVVDGEETRVYAEPDASKIPWVKENGVDIVLECTGFYTSEEKAQAHLDAGVKRVVISAPAGAMKTIVYNVNDDTLDANDKIISAGSCTTNCLAPMAYFLNNEFGIEVGTMTTVHAYTSTQMLLDGPVRGGNLRAARSAADNTIPHSTGAAKAIGLVIPELNGKLQGHAQRVPVVDGSLTELVSILKTKVTADQVNEAMKKHTIDNPSFGYDDREIVSGDIIGTTEGSIFDPTQTEVTTAGDFQLVKTVAWYDNEYGFTCQMIRLLEKFANL

SEQ ID NO: 21813 - protein, 371 aa, Glycine max
MKMQKFKLLLVLFFATCHSSLSITDGLLPNGDFEVGPKPSELKGSIVTTPNGIPHWTISGMVEYIKSGQKQGDMVLVVPHGTYAVRLGNEASIKQKIQVVKGMFYSLTFSASRTCAQEEKLNVSVVPSNEKSDWGVFPIQTMYGSNGCDSYACGFRADYPRVEIVIHNPGVDEDPACGPLIDSVALKLLHSPKRTRDNLLKNGNFEEGPYVFPKESWGVLIPPHIEDAYSPLPGWMVESLKAVKYIDSDHFAVPEGKRAIELVAGKESAIAQVVITIIGKVYDLTFVVGDANNSCEGSMVVEAFAGKDTIQVQYQSKGKGGFIRGKLRFKAMSTRTRIRFLSTFYTTKSDNTGSLCGPIIDDIRLLSVRYS

SEQ ID NO: 21814 - protein, 325 aa, Pseudomonas putida
MSNQLSTEQLLHAYEVMRTIRAFEERLHVEFATGEIPGFVHLYAGEEASAAGVMAHLRDSDCIASTHRGHGHCIAKGVDVYGMMAEIYGKKTGVCGGKGGSMHIADLEKGMLGANGIVGAGAPLVAGAALAAKIKGKDDVSVAFFGDGASNEGAVFEAMNMASIMNLPCIFVAENNGYAEATASNWSVACDHIADRAAGFGMPGVTIDGFDFFAVYEAAGAAIERARSGQGPSLIEVKLSRYYGHFEGDAQTYRAPDEVKNLRESRDCLMQFRNKTTRAGLLTAEQLDAIDARIEDLIEDAVRRAKSDPKPQPADLLTDVYVAYP

SEQ ID NO: 21815 - protein, 478 aa, Oryza sativa (japonica cultivar-group)
MDGSAAIPPRPAPTPPAPAPAPPQVFLRRSVLPPPPAPHHAPPPPGAHVHYFRAASPIPIFRAAASSRPPRPPPPSTTTAPPPPAAPAVTPARPPPQQPAVAVAAPPPATTMATATEEVAAPATGNPMANAADNEEKNERETVQSEVAKGETVQGPDKECTTGAVKGIKRPRKPKGFKKGSLRSNEGDAGPSLFSPNNCRYDSSLGLLTKKFINLLEGAEDGTLDLNKAAETLEVQKRRIYDITNVLEGVDLIEKTLKNMIRWKGFDMSKPKERERQISALKEEIESLYDEESRLDDEIMEAQEKLNALRVDEDRRKLLYVSKEDINAIPRFQGSTLIAVNAPRGTYIEVPDPNLDMDIYKDLDNQEKHYQIVFRSAMGPVDCFLISNHQETFNADQQMADNLDAAVTSGSSQAPQQMDYVQASEIGESNGVREHTSEPSKRDDPVPGIVKIVPSDDIAADYWLSSDADVSMTDTWGT

SEQ ID NO: 21816 - protein, 815 aa, GIBBERELLA ZEAE PH-1
MNVRQSSFSLAPPGPERRPSVVSRLSSVFSNADREAGTTTSTGAGLIEEEIAEIKRYEDFTTIDWVQDAAREQAKRKVRRKQAAGLYDKGQPGWRYQLWKSYDAAQAWIVVTIIGVAIGLNAALLNIITEWLSDVKMGYCETGFYLNENFCCWGEGNGCDQWHRWTGFEPFNYFVYLVFASFAPYAAGSGISEIKCIIAGFVMKGFLGWWTLIIKSICLPLAIASGLSVGKEGPSVHYAVCTGNVISRLFDKYKRNASKTREFLSASAAAGVAVAFGSPIGGVLFSLEEMSNQFPLKTLWRSYFCALVATAVLAAMNPFRTGQLVMFQVEYKNDWHFFELLFYVLIGIFGGLYGAFVIKWNLRVQSFRKRYLKDYAVLEATLLAAGTAIIAYPNAFLRIDMTESMEMLFSECGHGESYHGLCEPSKRWWNITSLFLATFLRLFLVILSYGCKVPAGIFVPSMAVGASFGRMVGIIVQAIHEANPTSVFFSACKPDEPCITPGTYALLGAAAALSGIMHITISVVVIMFELTGALNYILPTMIVVGVTKAVSELFGKGGIADRMIWFSGMPFLDSKEEHNFGVPVSAVMRTSVVSMPVHGLTLGEVQRLLADDRYQGFPVVEDKHTKVLIGYIGSIELRYAIDKMSRTSPLSETSRCTFAPSSSNLSTTSLHGDSSHSSTLDFSRYVDSTPVTAHPRLPLETVMELFQKIGPRVILIEYHGKLTGLVTVKDCLRYQFKVEAAENPKDNHRMEEGQEQLWNLLLRAGNWFSCRVSRYSGGRIRLSSSSGDERPLGRGQILDGDEEVLDEGVELESRR

SEQ ID NO: 21817 - protein, 513 aa, Zea mays
  unsure (1)..(513): unsure at all Xaa locations
ITMDPTKFRPSSSHDTTVTTTNAGAPVWNDNEALTVXGPRGPILLEXYHLIEKVAHFARERIPERVVHARGASAKGXFECTHDVTSLTCADFLRAXPGVRTPVIVRFSTVIHERGSPETIXRDPRGFAXVKFYTREGNWDLLGNNFPVFFIRDGIKFPDVIHAFKPNPRSHVQEYWXRVFDFLSHLPESLHTFFFLFDDVGVPSDYRHMEXGFGVNTYTFVSAAGKXAQYVKFHWEARRAGVRCIPDGRGRRPPGSGGRNHSHAXTQDLYDSIAAGSFPEWTLYVQVMDPDTEEQYDFDPLDDTKTWPEDLLPLRPVGRLVLDRNVDNFFNENEQLAFGPGLVVPGIYYSDDKMLQCRVFAYADTQRYRLGPNYLMLPVNAPRCAHHNNHYDGAMNFMXTADEEVDYYPSXRHAPLRQAAPAPRPLPPRPXVAGRREKATIRKPNDFKQPGERYXRSWDADRXQDRFVRRFADSLGHPKVXQELRSIWIDLLAKCDASLGMKIATRLNMKPNM

SEQ ID NO: 21818 - protein, 167 aa, Zea mays
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQVISVPPYIYKLMLR

SEQ ID NO: 21819 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLLCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 21820 - protein, 186 aa, Hordeum vulgare
KYPYIAGMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDALLMGADYYETEADKKLLAEKGGIPIGIGKNSHIKRAIIDKNARI

SEQ ID NO: 21821 - protein, 196 aa, Mitthyridium sp. Wall 2380
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDRFVNS

SEQ ID NO: 21822 - protein, 302 aa, Heterosigma akashiwo
RIGRLVARAALANPETSLVAINDPFMSIDYMVYLFKYDSVHGRYPGTVEVGENAIVVDGVSISVFAERDPTQIPWGAASATYVCESTGVFTTTEKASAHIQGGCSKVIISAPSADAPMFVMGVNADGYSKDMTVVSNASCTTNCLAPLVKVINDAYGIEEGLMTTVHAMTATQLTVDGPSKGGKDWRGGRCASANIIPSSTGAAKAVGKVIPEMNGKLTGMAFRVPTADVSVVDLTCRLVNGASMDEIKATVKAAAEGPMAGVLGYTDEDVVSQDFVDDKRSSIFDANACIGLTNNFVKLVS

SEQ ID NO: 21823 - protein, 204 aa, Zea mays; identical to SEQ ID NO: 18011

SEQ ID NO: 21824 - protein, 689 aa, Rhizobium leguminosarum bv. trifolii
MTDGTYGVRYQPDLIDGVNDDRANLEQFLAVVNRRTEHTIEGDFSGTSPATCFPNGSSFACSWDLDLAFQLGTALAAECQALGVNLLLGPGINIRRMPLGGRGYEYYSEDPVLTGYIRPAVIWELKGSGVGASLKHFACNNSEVQRTTMSSDVDERALREIYLAGFERAIRKGNPWTVMSSYNRLNGVQAAENKWLLTTVLRDEWHYDGVVVSDWHGIKDRAAAAKAGNDLDMPASKSRKKQLLAAVENGTVPLATIDQSCLRMLQLVRRVKAGERRDATWDLRENHTLARQMAAESIVLLKNEGNLLPLEMMAGRIAIIGDTAMDPIFQGWGCATTHPSMVDIPLDEIRAFAAPGVEVQHFPLGGGDKLKLAEAAIAGAASADVVLFFANTENGYDGEGSDRLHLGLADGQDALIARIATANPRTIVIVASPDAVEMPWLAEVPSVLATFFAGQGMGHAVASILFGRTNPSGKLTVTFPKRLQDVAAYLHYPGENDRHAYSEAIYVGYRYYDRRELSPLFPFRFGLSFTEFRYSDLELDRVVLKDGETLTATFSLTNTGRMTGKEICQLYGRPVKTRLHRPVRELKGFTKVGLKPGETKRVSIVFEARDTRYFDPELGQWLTDGGAYGIDVGASSRDIRLSAEVTCETPQLTPRRLTLETQPFLLFETPVGRERLAAFFRERLGLDGV

SEQ ID NO: 21825 - protein, 625 aa, Oryza sativa
  unsure (1)..(625): unsure at all Xaa locations
MLQVEEALAAVLSAAAASAAARAAEAVPLHDALGLVLAEDVRAPDPLPPFRASIKDGYAVVASDGPGEYPVITESRAGDDALGVVVTPGTVAYVTTGGPIPDGADAVVQVEDTEQLAGAPDGSKRVRILGCDIQKDSVVLKSSEHIGPAEIGLLATVGVTTVKVNKSFSYPVTECRRESRTTDHFEYESAGDELVEPATASLSRGQIRDSNRAMLIAAAIQHKCKVVDLGIAKDTEESLKEHMDAALSSDADIILTSGGVSMGDRDLVKPCLASMGKIHFEKIRMKPGKPLTFAEIVTEDSSKPSKKVLAFGLPGNPVSCVVCFNLFVVPAIRSLSGWSNPHLPRVHARLLHPLRGDPHRQEFHRAVIRWVPDDGSGRPGYVAESTGQQASSRLLSMKSANALLEVPLVGQMLEAGTSMQAILISDMTSSPFDKLPTASNPLPSHLFPSAKSVSTDLSQVPASQNTEVKVAILTVSDTVSLGAGPDRSGPRAISVVNSSSEKLGGATVVATAVVPDDVEKIKNILVKWSDIDRVSLILTLGGTGFTPRDVTPEATKSVIEKEAPGLTYVMLQESLKIINMPGNPNAVAECMEALLPALKHALKQIKXWDRSFRAASSGRGCSCEP

SEQ ID NO: 21826 - protein, 313 aa, Rhizobium sp. TAL1145
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 21827 - protein, 563 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAHEISHFAADDAIFTCDVGTPTVWAARYLKMNGKRRLLGSFNHGSMANAMPHGVGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVI

SEQ ID NO: 21828 - protein, 66 aa, Zea mays
MQNPNAATCEHKEEMDSRLVFGGNVYYTCTPDEVQQYFNFFGTVNKLTILTDNFGQPKVAAYAEFA

SEQ ID NO: 21829 - protein, 264 aa, ASPERGILLUS NIDULANS FGSC A4
MMEDFNSETDSDYTSYWRDWFISSRGNEYFCEIDEEYLTDRFNLTGLNTEVPYYQYALDLVTDVFDLDADDDLREQIEKSARHLYGLVHARYIVTTRGLAKMVEKYKKGDFGKCPRVMCEGHPLLPTGQNDVPNMSTVRLYCSKCEDIYNPKSSRHASIDGAYFGTSFTSMLFQVYPALLPEKSIRRYEPRIYGFRVHASAALARWQDRYREETRNRLRDAGVEVRYLEDDEEEELEDDDEDELVETKERVPGDAASGRMDIGN

SEQ ID NO: 21830 - protein, 78 aa, Zea mays
  unsure (1)..(78): unsure at all Xaa locations
RRLSTGEEDKKPTEGVCPHHTXKVKGQDGNEAVFRIYRSTHLXXLMNAYCDRQCVDMNALALLFDGLRLRQKQTPDEL

SEQ ID NO: 21831 - protein, 99 aa, Neurospora crassa
MADNAENGSGNAGSDAAAPAVEHLNIKVTDNNNEVFFKIKRSTKLEKLMTAFCERQGKTLASVRFLFEGQRVQPTDTPDTLEMQDGDCLEVHQEQVGGW

SEQ ID NO: 21832 - protein, 166 aa, Escherichia coli
  unsure (1)..(166): unsure at all Xaa locations
AEFQVTSNEIKTGEQLTTSHVFSGFGCEGGNTSPSLTWSGVPEGTKSFAVTVYDPDAPTGSGWWHWTVVNIPATVTYLPVDAGRRDGTKLPTGAVQGRNDFGYAGFGGACPPKGDKPHHYQFKVWALKTEKIPVDSNSSGALVGYXLNANKIATAEITPVYEIKLE

SEQ ID NO: 21833 - protein, 336 aa, Streptococcus pyogenes MGAS315
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHTNGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 21834 - protein, 247 aa, Antirrhinum majus
MGRGRVELKRIENKINRQVTFAKRRNGLLKKAYELSVLCDAEVALIIFSNRGKLYEFCSSSNMLKTIERYQKSSYGSLEVNHQAKDIEASSYKEYLKLKSKYESLQGYQRHLLGDDLGPLNMNDLEHLEHQLETSLKHIRSTRTQVMLDQLSDLQTKEKMMVDANKALERKLEEIYAANHLQQSWGGGGDHSNAYNDHQHAQSQGFFQPLECNSTLQIGFNDPVASSQMTAPTDAQNMHGLVPGWML

SEQ ID NO: 21835 - protein, 335 aa, Oligotropha carboxidovorans
MSVKVAINGFGRIGRNVLRAIVESGRDDIEVVAINDLGSVQANAHLLRYDSIHGRFPHEVKISGDTIDVGRGPIRVTAEKDPAALPHAAMGVDVALECTGIFTTREKAAAHLKAGARRVIVSAPADGADMTVVYGVNHQKLNKDHVVISNASCTTNCLAPVAKVLNDAVGIERGFMTTIHSYTGDQPTLDTMHKDLYRARAASMSMIPTSTGAAKAVGLVLPELNGKLDGVAIRVPTPNVSVVDFKFIAKKNTSVEEINEAISKASGGALKGILGATHEQNVSSDFNHDPHSSIFHMDQTKVIDGNFVRILTWYDNEWGFSSRMSDTAVALGRVM

SEQ ID NO: 21836 - protein, 72 aa, Triticum aestivum
MAATIQSVKARQIFDSRGNPTDEGDVCCSDGTFARAAVPSGASSGVYEALELRDRGSGYLGKGVSKAGDNVN

SEQ ID NO: 21837 - protein, 418 aa, Haloferax volcanii
MSYDQIEVPDDGEKITVDEETGELSVPDNPIIPIIHGDGIGTDVGPAAQKVLDAAAEATGRSVSWMRVYAGSSARDKYDENLPEDTVSAIRNHRVAIKGPLTTPVGAGFRSLNVALRKKLDLYANVRPTYHLDGVPSPVKNPSAMDMVTFRENTEDVYAGIEWEAGTDEVQKVKEFVEEEMGADGVIHDGPVGIGIQPITEFGTKRLVREAIEYALENDRRRTLVHKGNIMKFTEGAFRDWGYELAEEEFGDVTITEDELWEEYDGERPEDKVVVKDRIADNMLQQLLTRTADYDVIATMNLNGDYMSDAAGAQIGGLGIAPGANFGEGLCLAEPVHGSAPKYAGEDKVNPTAMILSGRLMFEYMGWKDAGKLIRDAVEKTISDGDVTYDLERQIEGGNKLATSEYADKVVENIKELA

SEQ ID NO: 21838 - protein, 248 aa, Thermoanaerobacter tengcongensis
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 21839 - protein, 504 aa, Staphylococcus epidermidis ATCC 12228
MSKQDGKLTGLFGAPVSDRENSMTAGQRGPLLMQDVYYLEQISHFDREVIPERRMHAKGSGAFGTFTVTNDITQYTNAKIFSEVGKQTEMFARFSTVSGERGAADLERDIRGFALKFYTEDGNWDLVGNNTPVFFFRDPKLFISLNRAVKRDPRTNMRSAQNNWDFWTGLPEALHQVTILMSDRGMPKGFRNMHGFGSHTYSMYNDKGERVWVKYHFRTQQGIENYTDEEAAKIVGMDRDSSQRDLYNAIENGDYPKWKMYIQVMTEEQAKNHPDNPFDLTKVWYKKDYPLIEVGEFELNRNPENYFLDVEQAAFTPTNIVPGLDYSPDKMLQGRLFSYGDAQRYRLGVNHWQIPVNQPKGVGVENLCPFSRDGQMRFLDNNQGGGPHYYPNNQGIYESQPEHKKPPFPTDGDGYEYNYRQDDDNYFEQPGKLFRLQSEDAKERIFTNTANAMDGVSKDVKVRHIRHCYKADPEYGKGVAKALGIDINQIDLETNQDETYENFK

SEQ ID NO: 21840 - protein, 58 aa, Santalum album
KKKGKLPENAKTTLLDWWSTHYRWPYPTEEEKMKLSEITGLDPRQINNWFINQRKGSR

SEQ ID NO: 21841 - protein, 335 aa, Methanopyrus kandleri AV19
MAYKIAVIPGDGIGPEVIEAALHVIEPLIDAEFVEGEAGDECAEKHGDPLPEDTLELCHEADAILFGAAGETAADVIVRLRQELDLYANIRPVRGFPGLRELTGEPYVRDDVDFVIVRENTEGLYSGIEGRFRDTAYTLRIITEEGTRRIAEVACDLAEERGSNTVTCVHKANVMRETCGLFREVCKEVVESRGLEFEEYYVDAAAMFMITEPERFDVVVTPNMFGDILSDEAAALVGGLGLAPSGNVGDRHGLFEPVHGSAPDIAGKGIANPFATILSAVMMLEWLGEDEAAEAVREAVGEAIREGVVTPDLGGDKKTMEVAEFVREAALNRVQ

SEQ ID NO: 21842 - protein, 566 aa, Bacillus anthracis str. A2012
MSSKTEEKLATGAQLLLEALEKEGVEVIFGYPGGAVLPLYDALYDCEIPHILTRHEQGAIHAAEGYARITGNPGVVIATSGPGATNVITGLADAMIDSLPLVVFTGQVATTLIGSDAFQEADIMGLTMPVTKHNYQVRKASDLPRIIKEAFHIARTGRPGPVVIDLPKDMVVEQGERCSDVQMDLPGYNPNYEPNLLQINKLLQAIQVANKPLILAGAGVLHAKASKELTSFARKYEIPVVHTLLGLGGFPPDDELFLGMGGMHGSYTANMALYECNLLINIGARFDDRLTGNLAYFAKEATVAHIDIDPAEIGKNVPTEIPIVASAKQALQVLLQPEGRKENHHEWISLLKNRKEKYPFSYKRNSESIKPQYAIDMLYEITKGEAIVTTDVGQHQMWAAQYYPLKTPDKWVTSGGLGTMGFGFPAAIGAQIAKPDELVIAIVGDAGFQMTLQELSVLKEHSLPVKVFILNNEALGMVRQWQDEFYNQRYSHSLLSCQPDFVALANAYGIKGVRIDDPLLAKKQLQHAIELQEPVVIDCRVLQSEKVMPMVAPGKGVHQMEGVEKR

SEQ ID NO: 21843 - protein, 388 aa, Glycine max
MNTFVKKTRGIISLATRGFASSSGAIKVKLLPSDTYNLEGRKIPTETETNAEELMHYFKEMSMMRRMEIALDNLYKAREIRGFCHLYDGQESIAMGIEAAVTFEDCLITAYRDHCQAYCRGDSVHQIIAELMGKRTGSTNGKGGSMHFYRKKTNFYGGHGIVGAQCALGTGLGFALKYQKKPNVAITMYGDGAANQGQLFEAANMAALWKLPVLYVCENNHYAMGTSTARGAASTEYYKRLMPVPGIRFAANNVFAVREVTKFAKEYSIKEGPICLEMQTYRYHGHSMSDPGVTYRKKQEIDEYRKTKDCITLVKQLIIDNKVATEEDLKEVERAIKKEVDETVEKVREDAYPDAKDLLKDVYIEDPKEPQHIRGVEYDKSFAPRGLP

SEQ ID NO: 21844 - protein, 313 aa, Nostoc punctiforme
MTNRRGAESAERRGEGRLMQKNQVRKAVIPVAGFGTRLFPATKVVKKELFPIIDRDGRAKPVILAIIEEAISAGIAEVGIVVQPDDREIFEDLLKNPPKKELFKKLSPQNQEYSRYLEDLGSKITFLLQEEQLGYGHAVFCAKDWVQDEPFLLMLGDHVYASDIQKSCASQLLDVYEQVNQSVVSLTTTPAEILHTAGCVTGVWQELNSILEVTQLYEKPTIEYAQQHLHVEGMAENEFLCIFGLYLLSPKIFDFLAEHINQNLRERGEFQLTSSLDRLRQEEGITGYVVKGKCFDTGLPDTYRQTMIDFRNF

SEQ ID NO: 21845 - protein, 416 aa, Oryza sativa (japonica cultivar-group)
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 21846 - protein, 562 aa, Glycine max
  unsure (1)..(562): unsure at all Xaa locations
MWRLKIADGGKDPYIFSTNNFVGRQTWEFDPEAGTPEERAQVEAARQNFYNNRFKFKACGDLLWRFQILRENNFKETISSVKIEDGEEITYEKVTATMTRAAHYLCALQTSDGHWPAQIAGAMFFVPPLVFCMYITGHLDSVFPEEYKKEILRYMYYHQNEDGGWGLHIEGHSNMFCTALNYICMRVLGEGPNGGHDNACARARKWIHDHGGVTHIPSWGKTWLSILGVYDWYGSKPVPPEFWVLPSFLPMHPSKIWCYCRLTYLPMSYLYGKRFVGPITPLILQLREELFTQPYEKVNWKKARNQCAKEDRYHPHSLIQDLVWDSLYIFIEPLLTRWPFNKLVREKALQVTMKHILYEDENSRYITIGCVEKALYMLACWVEDPNGDAFKKHLARVPDYLWVSEDGMAMQSFGSQGWDASLVIQALLATNLMEEIGPTLAKAHDFIKKTQVKDDPLGDFKSMYRHISKGSWTFSDQDQGWQVSDCTAETLNCCLLLSILPSEIVGEKMEPQRLYDSVNILLSLQSRKGGLAAWEPSGTQEWLEILNPTEFLGNIXVEHDYA

SEQ ID NO: 21847 - protein, 146 aa, Yersinia kristensenii
NESDMVLMPDASTAVMDPFFEDSTLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVV

SEQ ID NO: 21848 - protein, 304 aa, Cytophaga hutchinsonii
MNYQAILNQIQGDIQPYLGQGKVADYIPALAGINPSKFGMSIHTIDGITATIGDAQEQFSIQSISKILTLTMAVSLDDTNIWKRVGREPSGSKFNSLIQLELEQGIPRNPFINAGAHVITDLVYSHFDDPKEAILAFTRMVSMNDSISYDYVVAQSERETGNRNLAMGYFMKSFGNIENKVRDVLDVYFHQCSLAMSCTDLSKAFLYLANEGVLPTSEKTIITKKNSDRINALMLTCGMYDSVGDFAYRVGLPSKSGVGGGIVSIVPGEMVIAVWSPGLSESGNSLAGTKALELFVNYTGKTIF

SEQ ID NO: 21849 - protein, 102 aa, Zea mays
  unsure (1)..(102): unsure at all Xaa locations
ALTKTDFGDYDKKPPEGDADIFLKAKGHDSNEENYRIKRFTQLKKLMNAYCDRQSVDMNAIAFLFDGRMLRGEQTPDXLYMEDGYEIDAILHQTIGSFPSTT

SEQ ID NO: 21850 - protein, 350 aa, Arabidopsis thaliana
MGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHMEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 21851 - protein, 287 aa, Suaeda maritima subsp. salsa
GVHTFTLINRSGKVTYVKFHWRPTCGEKNLLEDEAIRVGGENHSHATQDLYETIAAGNFPEWKLYIQTMDPADEDKFDFDPLDTTKTWPEDILPLQPVGRLVLNKNVDNFFTENEQLAFYPAHVVPGIYFSNDKMLQARTFAYADTHRYRLGVNYLQLPVNAPKCPHTNNHRDGAMTMIHRDEEIDYFPSRFDPVREAERHPIPTAIISGRREKQIIPKENNFKEPGDRYRSWDPARQERFVGRFVKALSDPRLTYEICSIWETYLSQADKSLGMKVASRLNVRPTM

SEQ ID NO: 21852 - protein, 107 aa, Glycine max
  unsure (1)..(107): unsure at all Xaa locations
LNQKFDPFKGRVSPFRFFPPGGGGMLAHFLAHLPSWLKVREKNPSGEGVEFVANKVEVFLAEGNLVXPPNCLKKSVRGPQTPKIFPGWVSQPKTRVIFEQAGGVFQS

SEQ ID NO: 21853 - protein, 489 aa, Vaucheria dichotoma
MSSKSVQERTRIKSQRYESGVIPYAKMGYWDAFYNVKETDVLALFRITPQPGVDPVEAAAAVAGESSTATWTVVWTDLLTACDIYRAKAYRVDPVPGTTDQYFAYISYQIELFEEGSLANLTASIIGNVFGFKAVKALRLEDMRIPFAYLKTFQGPATGLVVERERMDKFGRPFLGATVKPKLGLSGKNYGRVVYEGLRGGLDFLKDDENINSQPFMRWRERFLYCMEGVNRAIAATGEVKGSYLNTTAGTMEEMYERANYAKSIGTIIVMIDLVIGYTAIQTMAIWARKADMILHLHRAGNSTYARQKNHGINFRVICKWMRMSGVDHIHAGTVVGKLEGDPLMVKGFYNTLLLTKLEIDLPQGLFFEMKWAALRKVVPVASGGIHCGQMHQLLYYLGDDVVLQFGGGTIGHPDGIQAGATANRVALEAMVLARNEGRDYLNEGPQILRDAAKTCGPLKTALDLWKDITFEYTSTDTPDFVETPTQNN

SEQ ID NO: 21854 - protein, 150 aa, Oryza sativa
QLRKSLEGIDKDSLLELALSSIPEDVLEYGSDTPMDLKQKFNSLKETVRHFSLIPAGGGGMLTHAVAHVASSIKIKEDQSGDGIESLLNRVENLIIHGDLSAAAEALERGLQGSEAAEIASEWVKQARKRAIAEQTLTLLHSYASSITFS

SEQ ID NO: 21855 - protein, 224 aa, Zea mays
MGPTGQCRTLLLLLLAAAAAAAAPEHESLLRLPSSARSLAPKTPRSAGADLIRALNLHPRDAFPRRPGGVGVGGSDALPAGTLVERPIRLASLVAGDDGTSVSNLGHHAGYYRLPTTHDARLFYFFFESRQHKEEDPVVIWLTGGPGCSSELALFYENGPFNIADNMSLLWNEFGWDQESNLIYVDQPTGTGFSYSSDSRDTRHNEATVSNDLYDFLQAFFKEH

SEQ ID NO: 21856 - protein, 525 aa, Ralstonia metallidurans
MTRLLRLCKILFVILYYGLDELVLSGFKNRRIKFLVRVITIGRKLDQPRGERLRMALTALGPIFVKFGQVLSTRRDLMPPDIADELAKLQDQVPPFESAVAVKIIEKSLGRRLTELFETFEHEPVASASIAQVHFATLRGGPSHGREVAVKVLRPGMLPVIDSDLALMRDMATWLERVWVDGRRLKPREVVAEFDKYLHDELDLMIEAANASQLRRNFAESDLLCVPEVFWDWCTSSVFTMERMHGIPISRTESLKAAGVDMHKLAEEGVEIFFTQVFRDGFFHADMHPGNILVSVRPETFGRYIALDFGIVGALSEFDKNYLAQNFIAFFRRDYHRVALLHVESGWVPPETRVEELESAVRACCEPYFDKPLREISLGMVLMRLFQTSRRFNVEIQPQLVLLQKTLLNIEGLGRQLDPDLDLWKTAKPFLERWMYEQVGWQGAWERIKIEAPQWAKMLPDFPRLAHQFLERRALQNNEGQERLLTQLVAEQRRTNRRLSTALLLMGGFLAGIVIVQALAWAGYW

SEQ ID NO: 21857 - protein, 289 aa, Archaeoglobus fulgidus DSM 4304
MNSKTHLLLALTMLIWAGSFIFIKIGLKELDPFNLAFYRFLLASPLLMAWVFWKRGLAKPSGSEWLHLSVLALSGVTLLYAFQFLALKYTTATNASILINTSAVFVALWGLVKGEANPRKLAGVFLSFAGVVLIVSKGTLEFFSSKTIFGDVLMIVDGFLWAVYTVLGSKMLLKYDHETLTAYAFALGTIFLIPFALMSGFANPVTFNPETVAALLYLSILCSVFAYVVWYYALTNADSTSVAVYVYLVPLFTAIFAFYALNEKPDFFTAIGGIITIAGVYLTTAKQHQ

SEQ ID NO: 21858 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 21859 - protein, 427 aa, Tuomeya americana
IEASAAVAGESSTATWTVVWTDLLTACDLYRAKAYKVDAVPNTSDQYFAYIAYDIDLFEEGSIANLTASIIGNVFGFKAVKALRLEDMRLPIAYLKTFQGPATGTIVERERMDKFGRPFLGATVKPKLGLSGKNYGRVVYEGLKGGLDFLKDDENINSQPFMRWRERYLFAMEGVNRAQAGTGEIKGHYLNVTAATMEIMYERAEFARELGSIICMVDLVIGYTAIQSMAIWARKADMILHLHRAGNSTYSRQKIHGMNFRVICKWMRMAGVDHIHAGTVVGKLEGDPLMIKGFYDTLLLSHLDVNLPHGIFFEQNWASLRKVTPVASGGIHCGQMHQLLDYLGDDVVLQFGGGTIGHPDGIQAGATANRVALESMVIARNEGRDYVNEGPQILRDAAKTCGPLQTALDLWKDISFNYTSTDTADFV

SEQ ID NO: 21860 - protein, 419 aa, Polyopes constrictus
ETDVLALFRITPQPGVDPVEASAAVAGESSTATWTVVWTDLLTACDLYRAKAYKVDAVPNSSEQYFAYIAYDIDLFEEGSIANLTASIIGNVFGFKALKALRLEDMRIPVAYLKTFQGPATGIVVERERMDKFGRPFLGATVKPKLGLSGKNYGRVVYEGLKGGLDFLKDDENINSQPFMRWKERFLYSMEGVNRAIAGTGEVKGHYMNVTAATMEDMYERAEFAKQLGTVIVMIDLVIGYTAIQTMGIWARKNDMILHLHRAGNSTYSRQKSHGMNFRVICKWMRMAGVDHIHAGTVVGKLEGDPLMIRGFYNTLLLTHLDVNLPQGIFFEQDWASLRKVTPVASGGIHCGQMHQLLDYLGNDVVLQFGGGTIGHPDGIQAGATANRVALEAIVIARNEGRDFVGEGPQILQNAAKTW

SEQ ID NO: 21861 - protein, 647 aa, Synechocystis sp. PCC 6803
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 21862 - protein, 270 aa, Prunus persica
ERPKVAYNNFSNEIPIISLAGIDEVEGRRADICKKIVEACEDWGIFQIVDHGVDTKLISEMTGLAREFFALPSEEKLRFDMSGGKKGGFIVSSHLQGEAVQDWREIVTYFSYPIRHRDYSRWPDKPEGWREVTQKYSDELMGLACKLLGVLSEAMGLDTEALTKACVDMDQKVVVNFYPKCPQPDLTLGLKRHTDPGTITLLLQDQVGGLQATRDDGKTWITVQPVEGAFVVNLGDHGHFLSNGRFKNADHQAVVNSNSSRLSIATFQNP

SEQ ID NO: 21863 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAINVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 21864 - protein, 118 aa, Zea mays
PRPRDDVYLGYGFPVGDDPMPFMHGMGYVVSWDVARWVSANGDILRHNDTHGPEDLLVGKWLNIGGRGRNRYDLKPRMYDLNWFMDNFRPDTIAVHMLKDNRRWAATFTYFNVTNSLP

SEQ ID NO: 21865 - protein, 305 aa, Synechocystis sp. PCC 6803
MHKFLPIAYFEDKFVPFEDAKISVATHALHYGTAAFGGLRGIPDPEDPGTILLFRLDRHGDRLSKSAKFLHYDISAEKIKEVIVDFVKKNQPDKSFYIRPLVYSSGLGIAPRLHNLEKDFLVYGLEMGDYLAADGVSCRISSWYRQEDRSFPLRGKISAAYITSALAKTEAVESGFDEAILMNSQGKVCEATGMNVFMVRNGQIVTPGNEQDILEGITRDSILTIAADLGIPTCQRPIDKSELMIADEVFLSGTAAKITPVKRIENFTLGGDRPITEKLRSVLTAVTENREPKYQDWVFKIPLNG

SEQ ID NO: 21866 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 21867 - protein, 319 aa, Yersinia pestis KIM
MSKIVSLGIHVLDVLGRHVNRFPPGGELDIINEIRLTVAGTAAGMSVDLAKLGGDVYAMGAVGLDESGNFIIDTLRRYGGNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 21868 - protein, 274 aa, Microbulbifer degradans 2-40
MIKKCLFPVAGYGTRFLPATKSMPKEMLPVVNKPLVQYGVEEALDAGLHEIGFVTGRGKRAIADHFDVSYELEHQIAGTDKEKYLESIRAVISKGSFSYTRQSEMRGLGDAILSGRRLIGDEAFGVVLSDDLCVAADEGVLAQMVRLYKQFRCSIVAVQEVPEDQISKFGVIAGDPIKDGIYQVTNMVEKPEPKDAPSNLAIIGRYILTPDIFEIIENTPPGKNNEVQLTDALMTQAQNGCVLAYKFKGTRFDCGSVAGFVEATNFVYENIYNK

SEQ ID NO: 21869 - protein, 482 aa, Oryza sativa
MALPFPVPRGAHWAVTSTAHVLVGFTGEMARVEQPRAPAPYNAAFLRKNPEEEEEEQQEAVRMATRHQRAAAAPQPANRGAAVAAGKQKAAATAAAGRPGARNRQALGDIGNVLNAHVVDGKIQLPEGINRPITRSFGAQLLKKAQENAVAANKIVVQNPARKEPAPKPAKKVVPRPENAAKASTGAGVNENKKPSESEGAGSSSGGSALKYSRKKVVNTLTSVLTARSKHACGITEKPKEVVEDIDKLDGDNQLAVVEYIEDIYNFYRTAQLERRPTDYMSSQVEVNPKMRAILADWIIDVHYKFELMPETLYLTMYVIDRYLSLQPVLRRELQLVGVAAMLIASKYEEMWAPEVQDLIHVCDNAYSRQHILAMEKNILNRLQWNITVPTPYVFLLRFIKAAGGDKELENMVFFFSEMALKEYGMASLCPSLVAASAVECAKVLVNAHAAAPESKLKTAYRKYASEQLGRVSLRPPAVCLA

SEQ ID NO: 21870 - protein, 427 aa, Psilosiphon scoparium
IEASAAIAGESSTATWTVVWTDLLTACDLYRAKAYKVDAVPNTSDQYFAYIAYDIDLFEEGSISNLTASIIGNVFGFKAVKALRLEDMRLPVAYLKTFQGPATGTIVERERMDKFGRPFLGATVKPKLGLSGKNYGRVVYEGLKGGLDFLKDDENINSQPFMRWRERYLFSIEGVNRAQAGTGEIKGHYLNVTAGTIEDMYERAEFAKELGSVICMIDLVIGYTAIQTMAVWARKTDMILHLHRAGNSTYSRQKIHGMNFRVICKWMRMAGVDHIHAGTVVGKLEGDPLMIKGFYNTLLLSHLDINLPQGIFFEQDWASLRKVTPVASGGIHCGQMHQLLDYLGDDVVLQFGGGTIGHPDGIQAGATANRVALESMVLARNEGRDYVNEGPQILKEAAKTCGPLQTALDLWKNISFNYTSTDTADFV

SEQ ID NO: 21871 - protein, 520 aa, Kluyveromyces lactis
MFTRDANGRHKEVDALVDDMVNFSFDTDAKVMLDPPSTPTRIRGSPSPTRSIVKNPENSLMDIDDDTQGDLTADITKSPKKLPKDFYKKSSKTKSKRLVSVCQMYFLDYYCDMFDYVISRRERTRQVINYLEEQRRSNLMGTEQITNEWQGYLTKETNILRKRRLKPKHKDFEMITQVGQGGYGQVYLARKKDTKEICALKILNKKLLMKLEGTDHVLTERDILTTTRSEWLVKLLYAFQDPQSLYLAMEFVPGGDFRTLLLNTKFLQAPHARFYISEMFCAVNALHQLGYTHRDLKPENFLIDSKGHIKLTDFGLASGTVSMERIESMKIRLQEVKNLEFPEFRERSMDDRRRMYNKLREEEVRYAHSTVGSPDYMALEVLEAKNYDFTVDYWSLGCILFESLVGYTPFSGNSTNETYENLRNWKHVLQRPKCDNGRYAFSDRTWELITRLIADPINRLKSFEHVKRMRYFSEIDFNTLRTIHPPFIPQLDNEEDVGYFDDFTNEEHMARYVDVFKRQD

SEQ ID NO: 21872 - protein, 311 aa, ASPERGILLUS NIDULANS FGSC A4
MASQSDKSVLGMPGFVVDFLMGGVSAAVSKTAAAPIERVKLLIQTQDEMLRSGRLDRKYNGLMDCFRRTTQAEGVVSLWRGNTANVIRYFPTQALNFAFRDTYKSMFAYKKDRDGYAKWMAGNLASGGMAGATSLLFVYSLDYARTRLANDAKSTKGGGERQFNGLIDVYKKTLASDGIVGLYRGFGPSVLGIVVYRGLYFGMYDSLKPVVLTGALEGSFLVSFLLGWGVTTGAGIASYPLDTVRRRMMMTSGEAVKYSSSFDAFRQIIAREGVKSLFKGAGANILRGVAGAGVLSIYDQVQLILFGKKFK

SEQ ID NO: 21873 - protein, 905 aa, Oryza sativa (japonica cultivar-group)
MCSPPSMRRHPLLPLLAAVLVGAAVRAGKIATEVVVPDFVASYLLFIDTYGVFLQSGGGGAFQAVVYNPAGQQDRYYLAVVHAPSKTCVWVANRDAPITDRAAPLRLTARGISAEDPNGTVVWSTPAFASPVAALRLDESGNLALLDGRNRTLWQSFDRPTDVLVSPQRLPVGGFLASAVSDSDYTVGGYRLDVTAADAALTWNGSLYWLLSIDVKSTRDRDGAVASMAVNGTGLYLLAADDTVLIQLPLPDAKLRIVKLGVEGKLVITSYASANATSPSPTDAGFVAPNSGCDLPLSCGALGFCAPNGNASSCTCPPLFASSHDGGCTPADGSKAMTVASCGGAGGDAAPTSYISLGNGVAYYANRFSRPDMVGSNGSSCQALCSGNCSCLGYFYDESSLSCFLVQHQIGSLVNANSRRGDMVGFIKVQSSQSPGSPSGSSSNNSTLIAILLPTIVAFVLVVVVGAVIVVSWRKQERRAGRRASRSRDVQLRRHRSPASDSAHLVYGNDDDGNDIVIPGLPTRFTHEEIEDMTNSFRIKIGAGGFGAVYKGELPDSSAVAVKKIEGVGMQGKREFCTEIAVIGNIRHVNLVRLRGFCVEGQRRLLVYEYMNRGSLDRTLFRPAAGQPLEWKERMEVAIGAARGLAYLHFGCDQRIIHCDVKPENILLADGGQVKIADFGLAKLLTPEQSGLFTTMRGTRGYLAPEWLTNTAITDRTDVYSFGMVLLELVRGRKNRSEHVSDGAGAATGDDSNSSNGTTGSSSRGARSDYFPLMALEGHEAGQYAALADPRLEGKVVAGEVERVVKVGLCCLHEDPQLRPSMAMVAGMLEGTMELWEPRVQSLGFLRLYGRGFAGPADGSGGSGGGIKQAMAGSNGDHTRSGTTTVTTMSGWPSYMSSSQLSGPR

SEQ ID NO: 21874 - protein, 367 aa, Oryza sativa (japonica cultivar-group)
MELTESKCDGGQEVSLLDAQLELYWNTFAVIKSMALKSALDLRIADAVHLHGGAATLAEIASEVALHPSKIPCLRRLMRALTVSGVFAAAVKPGDGGGGEPVYELTPSSRLLVGSSNLSGIMSMILHPTLVVPFLGVGEWLRRDREPPEEDPYCIFKQAHGRSLWELAGRDAAFDALINDGMVSDSRVIMDYVVREHGEVFRGIASLVDLAGGLGAAAQVISKAFPEVRCSVMDLGHVVAKAPAGTDVEYIAGDMFESVPPADAVFLKWVLHDWGDDDCIKILKNCKKAIPPRDKGGKVIIMDIVVGAGPSDQKHREVQALFDMYIMFVNGIERDEQEWKKVFMGAGFSGYKIMPVLGFRSMIEVYP

SEQ ID NO: 21875 - protein, 424 aa, Sorghum bicolor
KLEALDCGKPYDEAVWDMDDVAGALSTLRDSAEALDKRQNSPVSLPMETFKCHSGESLLGVVGLITPWNYPLLMATWKVAPALAAGCTADVKPSELASVTCLELADICKEVGLSSGVLNIVTGLGPDAVLLCQGSPDVDKVSILLGRFETGKKIMARAAPMVKPVTLELGGKSPIVVFDDVDIDKAVEWTLFGCFWTNGQIAAHISSSYPYKIAKEFNERMVAWAKNIKVSDPLEEGCRLGPVVSEGQYEKIKKFISNAKSEGATILTGGLRTAHLEKGFFIEPTIITDITTSMEILEGGVLVSLCVKISTEDEAIELANHTQYGLAGAVLSGDRERCQRLSEEIDAGCIWVNCSQPCFCQAPWGGNKRSDFGRELGEGGIDNYLSVKQVTEYISDEKWGWYQSPLQAVNEKMARKLVCFIRIK

SEQ ID NO: 21876 - protein, 405 aa, Ferroplasma acidarmanus
MDILQGIGLALIAIGLVYVIYQFPIIYFGYKDFTKYDIDFSKLNEAQFSGLKMYKPMVSIIVPAKNEETVIKRTIESILNQTYTNFELFVVVDNSSDNTYKIAKEYESRDKRVNVFNRPDGKSKASALNFCFEKTKGEVIATYDADTMLLPNTLENAVYGMNYFNVDVLQGYNSYINREENIFTRLAVIDEILVKATLIGRTHFNLFVPVAGSNQYFKRKVIESIGGWDDNFLTEDLESSIRISNARYKSAYLGSAKALQETPASYSEYFRQRTRWLRGYHQVFFHSKKRFSKFTDFDALMIVLAPTFSGILFFGWLYISLLNFYNPFVHSMRTYFISLILISLIIYVVALVLVLIKKRQNFIYIPLIYIYLTLNSLIAIYTLFLEITGAKRVWHKVKKTGKTTL

SEQ ID NO: 21877 - protein, 230 aa, Glycine max; identical to SEQ ID NO: 9167

SEQ ID NO: 21878 - protein, 364 aa, Neurospora crassa
MASLLNQLRGLTTVDCDTLDAHGEQHNTAISAENKAIVLAEITKLDANGKLIYQTLIDEIIPIAHWMFGNQTDATVEELASELLAVGLALRFIPHLNGFIHIQTNPKWCYSTEKTVKNAERIVAHLKHLAPDFDTSRICIKIPATWEGLQACRELERRHSIATLATIVFSMEQVALAVDAGCRYVAPYVNELRVHFDATYTDANKDRAALFCGAAQRYCDEVASSASAAEAAHGSLNLQMQTQVMAASLTSVEEVMRLAGAVKHITVSPPLLMELEATPAAGWPGASTVGAAAAITGSRVNGDAVRLRELVRDQSQWRLAFTRAEAGESERKLGQAIGIFCDMQDQLERLVRRWDLTGKKYARG

SEQ ID NO: 21879 - protein, 303 aa, Triticum aestivum
  unsure (1)..(303): unsure at all Xaa locations
MASRTAGRGGRPLLGGGAGAGRRGKPSKAILAALLLASVALLLLLALGALSLPAGSGRGAVLSLPLPRPRFRRSAFESRLEKRGEKGEPWTEVLSWEPRAFIYHNFLSKEECQYLISLAKPHMKKSTVVDSATGGSKDSRVRTSSGTFLKRGQDKIVRTIXEKRISDFTFIPVENGEGLQVLHYEVGQKYEPHFDYFHDDFNTKNGGQRIATVLMYLSDVEEGGETVFPSAKVNSSSIPFHNELSECAKRGISVKPKMGDALLFWSMRPDGTLDPTSLHGGCPVIKGDKWSSTKWIRVHEYKV

SEQ ID NO: 21880 - protein, 593 aa, Zea mays
  unsure (1)..(593): unsure at all Xaa locations
MGTLGDRLRAFSTNRWLVFVAAMWLQSMAGIGYLFGTISPVIKAALGYNQRQVAALGVAKDLGDCVGFLAGSLSAVLPSWAMLLIGSVQNFLGYGWLWLIVTRQAPALPLWMMCVLIYVGTNGETFFNTTALVTCIQNFPKSRGQTVGIMKGFAGLSSAILTQLYAVMHTPDHATLVFMVAVGPSLVAIGLMFIIRPVGGHRXQVRPSDKNSFLFIYTICLLLASYLVGVMLVQDFMQLSDNVVNFLTVILLILLVLPIVIPVTLTLSSKTQHPIEEALLSDPSKGETSTSQEKEDQPEVILSEVEEEKPKDIDSLPPSERRKRIEELQTKLVQAAARGGVRIRRQPRRGENFTLVQALVKADFWLIWWSLLLGSGSGLTVIDNMGQMSQAVGFKDGHIFVSLTSIWNFLGRVGGGYFSEIIVREHTYPRHIALVICQILMAVGHFLFAMAWPGTMYVGTFLVGLGYGAHWAIVPAAVSELFGVKHFGAMYNFLTVANPAGSLVFSGLIASNLYDYEAEKQAQRRQITSLTSPRLFHSMGFLADGTLKCEGAVCFFVSSLIMSAFCVVGAGLSLIVVYRTRRVYTHLYGSNRT

SEQ ID NO: 21881 - protein, 187 aa, Chamaecyparis pisifera
ICTYFAQPLYQRDYSRWPDKPEGWREIVDKYSEALMGLASKLLAIVSEALGLEADAVTKACVEMDQKVVINYYPKCPEPDMTLGLKRHTDPGTITLLLQDQVGGLQATKDDGLNWITVQPVQGAFVVNLGDHMHYLSNGKFKTADHQAVVNSNYSRLSIATFQNPSQEASVYPLELEEGEKSFMEEP

SEQ ID NO: 21882 - protein, 243 aa, Oryza sativa
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPLTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 21883 - protein, 94 aa, Zea mays
FSSAKATVRRFAVVRRTRDPHRAFRASMVEMIASKRMVGRPDELETLLACYLSLNADEHHDCIVKVFRQVWFELNNASRATATAPPQRTAHLSG

SEQ ID NO: 21884 - protein, 1168 aa, Arabidopsis thaliana
MSTTEPSPENDRDPQPTTISTPTSTNAKLLKKIPAIPFRHSDKEGEDEQAKTDEVTTELAGEGPMSHDSPEILAPSSLGLNHIRTKSSPAPSPLRFSSATPLISPGQDDKDVAKEKPRVGVVDARADARARWPIPPHQPDQGKKVQWSQSKSQRVPANSNPGVESTHVGLAKETQSPRFQAILRVTSGRKKKAHDIKSFSHELNSKGVRPFPVWRSRAVGHMEEIMAAIRTKFDKQKEDVDADLGVFAGYLVTTLESTPESNKELRVGLEDLLVEARQCATMPASEFWLKCEGIVQKLDDKRQELPMGGLKQAHNRLLFILTRCNRLVQFRKESGYVEEHILGMHQLSDLGVYPEQMVEISRQQDLLREKEIQKINEKQNLAGKQDDQNSNSGADGVEVNTARSTDSTSSNFRMSSWKKLPSAAEKNRSLNNTPKAKGESKIQPKVYGDENAENLHSPSGQPASADRSALWGFWADHQCVTYDNSMICRICEVEIPVVHVEEHSRICTIADRCDLKGINVNLRLERVAESLEKILESWTPKSSVTPRAVADSARLSNSSRQEDLDEISQRCSDDMLDCVPRSQNTFSLDELNILNEMSMTNGTKDSSAGSLTPPSPATPRNSQVDLLLSGRKTISELENYQQINKLLDIARSVANVNVCGYSSLDFMIEQLDELKYVIQDRKADALVVETFGRRIEKLLQEKYIELCGLIDDEKVDSSNAMPDEESSADEDTVRSLRASPLNPRAKDRTSIEDFEIIKPISRGAFGRVFLAKKRATGDLFAIKVLKKADMIRKNAVESILAERNILISVRNPFVVRFFYSFTCRENLYLVMEYLNGGDLFSLLRNLGCLDEDMARIYIAEVVLALEYLHSVNIIHRDLKPDNLLINQDGHIKLTDFGLSKVGLINSTDDLSGESSLGNSGFFAEDGSKAQHSQGKDSRKKHAVVGTPDYLAPEILLGMGHGKTADWWSVGVILFEVLVGIPPFNAETPQQIFENIINRDIPWPNVPEEISYEAHDLINKLLTENPVQRLGATGAGEVKQHHFFKDINWDTLARQKAMFVPSAEPQDTSYFMSRYIWNPEDENVHGGSDFDDLTDTCSSSSFNTQEEDGDECGSLAEFGNGPNLAVKYSFSNFSFKNLSQLASINYDLVLKNAKESVEASNQSAPRPET

SEQ ID NO: 21885 - protein, 920 aa, Oryza sativa
MDSPRFRAILRATSGRRKRAPDVKSFSHELNIRGPLLHPLQQRKPRGCVNSPEEFIGAIRTKFIRLKEEVDAELGVFAGDLVGALDKADGDEERVALEDLLVVAQRCAEMSPEELWVKCECIVQGLDDRRQELTAGVLKQAHTRVLFILTRCTRLLQFRKEGGGYVAADDKQHVLSLHQLSDLGLYPFKVAGGSSELGRKSTSSLTELKERLIRRRMLEHKQLTLDFSAGRVISSDTGGDSPGSGGKISSWKKLPSPAEKTLHKVTEPTTEEKTTPTKKKAITRNKVAVDEIVERIDAASIHPDGLSYLGDSAVKLEVPSGFPEAQQIIVDGKPRMICRICDFEIPMVCAEGHFIVCTLADRCDSKGLNTDQRLQRVAEGALTPASGSMPQSPLLTPRTSHAESQLTKHKAFVELENFQQVESLMTIARGIERIKNSEYNSLEDLSSYLEDLNAVIDTRKVDALVVETFGRRIAKLLQEKFIQLCGQIEDSNTDSLGSIDEDGPMESSVSSRTSQMNGKFKDRTSIEDFEIIKPISRGAFGRVFLAKKRVTGDLFAIKVLKKADMIRKNAVESILAERDILISARNPFVVRFFYSFTCRENLYLVMEYLNGGDLYSLLRNLGCLDEDMARTYMAELVLALEYLHSMNVIHRDLKPDNLLISRDGHIKLTDFGLSKVGLINSTDDLSGPDVSNVLVGDHQPADAEQRAQKREQRQKQAAVGTPDYLAPEILLGMTHGPTADWWSVGVILFELLVGIPPFNAEHPQIIFDNIMNREIPWPQVPEELSFEAYDLIDKLLIENPVQRLGATGAGEAAFIPSTDDEYDTSYFACRHTWDDQVNVASNDYDDRSETSSMSCGSSPHSCDYEEDADEFGSMEEFGAPSLSVKYSFSNFSFKNISQLASMNYDLITKHNEDPLQSSKS

SEQ ID NO: 21886 - protein, 231 aa, Schizosaccharomyces pombe
MQLYSSESESDDSQYWVDWFLGLKGNEFFCEVDEDFIQDRFNLTGLSHEVPHYSQSLDLILDVLDPDLPEEVQDEVEASARHLYGLIHARYILTAQGLYKMLEKYKKCDFGHCPRVLCNGQPMLPVGLSDIAHAKSVKLYCPRCEDVYTPKSQRHASIDGAYFGTSFPHMLFQVYPELAVPKSQERYIPRIFGFKVHSYSATFKKQDVYKEKQKKRLQGAEAESKNKLAIT

SEQ ID NO: 21887 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 21888 - protein, 253 aa, Zea mays; identical to SEQ ID NO: 3990

SEQ ID NO: 21889 - protein, 483 aa, Solanum tuberosum
MGKKLKYTKFQLRSNVVKPNICMSLTTDIAGEAKLKDLERQKKGDARTVVAIILGGGAGTRLFPLTKRRAKPAVPMGGAYRLIDVPMSNCINSGINKVYILTQFNSASLNRHIARAYNFGNGVTFESGYVEVLAATQTPGELGKRWFQGTAHAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASIGKVYVFKKDILLNLLRWRFPTANDFGSEIIPASTKEFCVKAYLFNDYWEDIGTIRSFFRANLALTEHPPRFSFYDATKPIYTSRRNLPPSAIDNSKIVDSIVSHGIFLTNCFVEHSVVGIRSRIGTNVHLKDTVMLGADYYETDAEIRSQLAEGKVPLGIGENTRIKDCIIDKNARIGKNVVIANSEGVQEADRSSEGFYMASGITVISKNSTIPDGTVI

SEQ ID NO: 21890 - protein, 468 aa, Phyllariopsis brevipes subsp. pseudopurpurascens
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVSEGPEILRNAARTCGPLKAALDLWKDITFDYTSTDTPDFVEVPTESN

SEQ ID NO: 21891 - protein, 87 aa, Gordonia sputi
HNMQWDFWTLRPETAHQVTWLMGDRGIPKSWRHMDGFGSHTYQWVNADGERFWVKYHFKTDQGIEFLTQAEADTLAGSDPDYHRKDL

SEQ ID NO: 21892 - protein, 246 aa, Cedrus atlantica
YTFTLRKKGPEDVILRVIYCGICHSDLVQMHNEVGMSRYPMVPGHEVVGIVTEIGSEVKKFKVGDHVGVGCIVGSCRSCGNCNDSMEQYCSKRIWTYNDVNHDGTTTQGGFASTMVVDQMFVVRIPENLSLEQAAPLLCAGVTVYSPMKHFGMTEPGKKCGILGLGGVGHMGVKIAKAFGLHVTVISSSDKKKEEALEVLGADAYLVSKDAEKMQEAAESLDYILDTIPVGHPLEPYLSLLKTNGK

SEQ ID NO: 21893 - protein, 537 aa, Clostridium perfringens str. 13
MSKGQSAKRLKEIVRVFTYYGFDFLISSKLPNSKKVEPRPQALREALEELGATFVKIGQILSTRPDLLPKAYIEELEKLQDNNEITDFHKVKEIFYESFGTDINTYFLEFSETPLASASIAQVHRAQLIDGRDVVVKVQHYKIDEKMKLDLSILRRLSKLTSSHIANTLINPVEAFKEIEEATLKELDFEKEAKNTKRFRELNKNVACVGAPIIIDKLTSKKILTMEYIDGCKVTDFNILKEEGYDFEDIANKLANSFFKQVLEDGFFHGDPHPGNLFIREGKIYFIDFGLVGTLEANLRNWLNKAMIAMVLGDIDTLVDFVNAIGIKKGKVEYSILYDDLKNIVSKYINASLKTIKISDLFKEIFEIAERNNIQFPRELVALVRSIVILEGVIAKIDPDLEIMECIYPYVKERNKEEMLKSLNKDKLLTEAYKFASKSIEIPTKFSELVDSLTKGRAKLQFEMKGLDKPLTDLNRMVNRVAFSLIVGCMIIGSSLIVNAKTGPTFQGVPILGLIGFIVSGIFGLWLLISIIKSGFF

SEQ ID NO: 21894 - protein, 339 aa, Escherichia coli O157:H7
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLPVPAFTLIAGDRSVSGSATGTPYELRKLMRFAARSKVAPTTELFPMSKINDAIKHVRDGKARYRVVLKADF

SEQ ID NO: 21895 - protein, 98 aa, Ficus carica
DEIDFEFWGNRSGQPYTVQTNIYAHGKGDREQRVNLWFDPAADFHSYTIMWNHHHVVFYVDEVPIRVYKNNEAKGIPYLLHQPMGVYSTLRNGDDWAT

SEQ ID NO: 21896 - protein, 510 aa, Pseudomonas syringae pv. tomato str. DC3000
MPLLNWSRHMVHLTAIGLISIPAAYAADTLTRDNGAAVGDNQNSQTAGAQGPVLLQDVQLLQKLQRFDRERIPERVVHARGTGVKGEFTASADISDLSKATVFKSGEKTPVFVRFSSVVHGNHSPETLRDPHGFATKFYTADGNWDLVGNNFPTFFIRDAIKFPDMVHAFKPDPRTNLDNDSRRFDFFSHVPEATRTLTLLYSNEGTPTGYRFMDGNGVHAYKLVNAKGEVHYVKFHWKTLQGIKNLDPKEVAQVQSKDYSHLTNDLVGAIKKGDFPKWDLYIQVLKPEDLAKFDFDPLDATKIWPDVPEKKIGQMVLNKNVDNFFQETEQVAMAPANLVPGIEPSEDRLLQGRVFSYADTQMYRLGANGLSLPVNQPKVAVNNGNQDGAMNSGKTTSGVNYEPSRLEPRPADEKARYSELPISGTTQQAKITREQNFKQAGDLYRSYNAKEQTDLVQSFGESLADTDTESKNIMLSFLYKADPTYGTRVTEAAKGDLAKVKSLAASLKD

SEQ ID NO: 21897 - protein, 312 aa, Salmonella typhimurium
MKVAVLAAAGGIGQALALLLKNQLPSGSELSLYDIAPVTPGVAVDLSHIPTAVKIKGFSGEDATPALEGADVVLISAGVARKPGMDRSDLFNVNAGIVKNLVQQIAKTCPKACVGIITNPVNTTVAIAAEVLKKAGVYDKNKLFGVTTLDIIRSNPFVAELKGKLPTEVEVPVIGGHSGVTILPLLSQIPGVSFTEQEAAELTKRIQNAGTEVVEAKAGGGSATLSMGQAAARFGVSLVRALQGEKGVVECAYVEGDGQYARFFSQPLLLGKNGVEERKSIGTLSAFEQHSLDAMLDTLKKDIQLGEEIINK

SEQ ID NO: 21898 - protein, 147 aa, Salmonella enterica
TFMPKPMFGDNGSGMHCHMSLAKNGTNLFSGDKYAGLSEQALYYIGGVIKHAKAINALANPTTNSYKRLVPGYEAPVMLAYSARNRSASIRIPVVESRKARRIEVRFPDPAGNPYLCFAALLMAGLDGIKNKIHPGEAMDKNLYDLP

SEQ ID NO: 21899 - protein, 182 aa, Glycine max
SKFYPDYRADDIRAAKKKAVAYIKRAQRKDGSWYGSWGICFTYAAMFALESLASVGETYETSEHSRRGCEFLIEKQQADGGWGESYLSSEKHVYVQHEKSQVVQTAWACLALMEAQYPHKEPLERGIKLLMARQQRNGEWLQESIEGVFNQSCMISYPNYKFYWPIRALGLYSKKFGNEALQ

SEQ ID NO: 21900 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 21901 - protein, 355 aa, GIBBERELLA ZEAE PH-1
MSRANPPNAAGSRKISFNVSEQYDIQDVVGEGAYGVVCSAIHKPSGQKVAIKKITPFDHSMFCLRTLREMKLLRYFNHENIISILDIQKPRSYESFQEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 21902 - protein, 481 aa, Haemophilus somnus 129PT
MNIQHLLKTQAYINGEFISAKNHRTFPVINPANQQVICEIACCGKEETELAIKSAKQAQVHWKKYTAKERSKILKKWFELIMQHQESLAYLLSLEQGKPLSESRAEIAYGASFVEWFAEEAKRAYGEIIPQVREDHRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 21903 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQPVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 21904 - protein, 322 aa, Escherichia coli
MQRSEQGYIPVSGHLQRQLALMPEFHRPEMPDFTIHEYTPLMDSSDMTPEDWQHIAEDIKAHYDDYDGFVILHGTDTMAYTASALSFMLENLGKPVIVTGSQIPLAELRSDGQINLLNALYVAANYPINEVTLFFNNRLYRGNRTTKAHADGFDAFASPNLPPLLEAGIHIRRLNTPPAPHGEGELIVHPITPQPIGVVTIYPGISADVVRNFLRQPVKALILRSYGVGNAPQNKAFLQELQEASDRGIVVVNLTQCMSGKVNMGGYATGNALAHAGVIGGADMTVEATLTKLHYLLSQELDTETIRKAMSQNLRGELTPDD

SEQ ID NO: 21905 - protein, 364 aa, Pichia anomala
MSEKTIVVLPGDHVGTEITNEAIKVLKAIEEVRPNVKFNFQHHLIGGAAIDATGVPLPDEALEAAKKADAVLLGAVGGPKWGTGAVRPEQGLLKIRKELNLYANLRPCNFASESLLELSPIKAEFAKGTDFTVVRELVGGIYFGERKEDDGSGVASDTETYSVPEVQRITRMAAFMALQHNPPLPIWSLDKANVLASSRLWRKTVTETIEKEFPQLTVQHQLIDSAAMILIKSPTTLNGIVITSNMFGDIISDEASVIPGSLGLLPSASLASLPDTNKAFGLYEPCHGSAPDLPANKVNPIATILSAAMMLKLSLDLFEEGVALEKAVKEVLDAGVRTGDLRGSNSTKEVGDAAVEAAKRILKN

SEQ ID NO: 21906 - protein, 488 aa, Chordaria chordaeformis
MPEDVQNRTRIKSERYESGVIPYAKMGYWDADYNVKATDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENFNSQPFMPWKERFLYWMEGVNRAAAATGEVKGSYLNITAATMEQMYERAEYAHSIGSVIVMIDLVIGYTAIQSMAIWARKYEMILHLHRAGNSTYARQKNHGINFRVICKWMRMCGVDHNHAGTVVGKLEGDPLMVKGFYNSLLLTHLKINLAEGLFFDMDWAALRKCVPVASGGIHCGQMHQLLYYLGDDVVLQFGGGTIGHPDGIQSGATANRVALESMVLARNEGRDYVGEGPEILRRAATTCGPLKAALDLWKDITFDYTSTDTPDFVEVATESR

SEQ ID NO: 21907 - protein, 258 aa, Triticum aestivum
  unsure (1)..(258): unsure at all Xaa locations
MSSAVSKRLEGKTVLITGASSGIGKSTAFEFARTSPKNLKLVLTARRIDSLKQIAEEIVKEVGDGVKVHPVQLDVSKPDEVRSFVSKLPAEFSEIDVLVNNAGLVKGVDKAPEIKEEDINVMFATNVTGLINMTQAILPGMLKRNNGEGAGDIINIGSIAGREPYPGGSIYCATKAAIHSFTESLRKELISKRVRVIRIDPGQVEAEFSXVGRFYGDKSKADAVYAGCEPLTPDDIAXGIVFAAGRRGKCVIADTLIF

SEQ ID NO: 21908 - protein, 146 aa, Clostridium tetani E88
MFDMIPFKRNNSMKRDSYFDEFFDNFFNNDFLVPIKFPKNNFRADLKETNNEYIIEADLPGISKDAVKVNYSNNNLVISAKREDIIENKDENYIRRERSYGEFKRAFYVDNVDENNIKASFKNGVLRINLTKLEDTTKARKQIEIE

SEQ ID NO: 21909 - protein, 713 aa, Bacillus circulans
MKRFMKLTAVWTLWLSLTLGLLSPVHAAPDTSVSNKQNFSTDVIYQIFTDRFSDGNPANNPTGAAFDGSCTNLRLYCGGDWQGIINKINDGYLTGMGITAIWISQPVENIYSVINYSGVHNTAYHGYWARDFKKTNPAYGTMQDFKNLIDTAHAHNIKVIIDFAPNHTSPASSDDPSFAENGRLYDNGNLLGGYTNDTQNLFHHYGGTDFSTIENGIYKNLYDLADLNHNNSSVDVYLKDAIKMWLDLGVDGIRVDAVKHMPFGWQKSFMSTINNYKPVFTFGEWFLGVNEISPEYHQFANESGMSLLDFRFAQKARQVFRDNTDNMYGLKAMLEGSEVDYAQVNDQVTFIDNHDMERFHTSNGDRRKLEQALAFTLTSRGVPAIYYGSEQYMSGGNDPDNRARIPSFSTTTTAYQVIQKLAPLRKSNPAIAYGSTQERWINNDVIIYERKFGNNVAVVAINRNMNTPASITGLVTSLPQGSYNDVLGGILNGNTLTVGAGGAASNFTLAPGGTAVWQYTTDATAPIIGNVGPMMAKPGVTITIDGRGFGSGKGTVYFGTTAVTGADIVAWEDTQIQVKIPAVPGGIYDIRVANAAGAASNIYDNFEVLTGDQVTVRFVINNATTALGQNVFLTGNVSELGNWDPNNAIGPMYNQVVYQYPTWYYDVSVPAGQTIEFKFLKKQGSTVTWEGGANRTFTTPTSGTATMNVNWQP

SEQ ID NO: 21910 - protein, 178 aa, Magnetospirillum magnetotacticum
MTDQPVAIGVVTISDRASRGVYEDKGGPAIIAEMNRFLSTPWRPVARVVEDEQALIEATLKELADVEGCSLIVTTGGTGPAPRDVTPEATEAVCDKMMPGFGELMRAESLKVVPTAILSRQTAGIRGRSLIINLPGKPSAIADCLNAVMAAVPYCIDLIGGAFIDTNPAVCKAFRPKK

SEQ ID NO: 21911 - protein, 523 aa, Lycopersicon esculentum
MAGGGFTTSGNGARISRLKSHQLVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLVPETKNVPIEEMTERVWKQHWLWKRFMVNEDDVDMIKKNGHANGYDPTSRL

SEQ ID NO: 21912 - protein, 634 aa, Xylella fastidiosa Dixon
MSTSSHSGDCAAVSSNSNSTIILSAIGVVFGDIGTSPLYTLKEAFSPNYGLAPNHDTVLGILSLIFWAMMLVVTIKYVIVIMRVDNDGEGGIMALTALTQRTMPFGSRSIYIVGILGIFGTSLFFGDGIITPAISVLSAVEGLEVAEPHMKAFVVPITLAVLILLFLCQRFGTERVGKTFGPITFLWFIAIGVVGVYNILQAPEVLYAINPWWGLHFFLEHGWHSMFVLGAVVLAVTGGEALYADMGHFGAKAIRHAWMYVVLPMLALNYLGQGALVLSNPTAIGNPFYQSIPDWGLYPMIALATAAAVIASQALITGSYSLSSQAMQLGYIPRMNVRHTSQSTIGQIYVPTVNWTLLTLVILTVIGFGDSTSMASAYGVAVTGTMMITTVLMIIYARANPRVPRLMLWMIAIVFIAVDGAFFYANIIKFMDGAWFPLLLGVVIFTFMRTWLRGRKLLHEEMRKDGINLDNFLPGLMLAPPVKVPGTAVFLTADSTVVPHALMHNLKHNKVLHERNVFLTVKTLKIPYAANSERLKIEPISNGFYRVHIRFGFMETPDVPLALMCSKDHAEIDFDPMHTTFFVSRETVIPSANRGMPIWRDKLFVLMHRNAAPANAFFRIPGNRLVELGAQVEI

SEQ ID NO: 21913 - protein, 113 aa, Zea mays
  unsure (1)..(113): unsure at all Xaa locations
GADQAVRQPFQSRFDLLLLLAGPNTTRLASKLARGPTVIMASSETAVAPFKGLKSAAGFPVSRRRTRSLGNLRNGGGIRSMQVWPAYGTKKFKTLSYLPPXLSTDNLLKQVDY

SEQ ID NO: 21914 - protein, 504 aa, Triticum aestivum
MATTSRLLLLLAAVCLLAGAADALRLPPDASFPGAQAERLIRALNLLPGASSGRGGKVGAGAEDVAPGQLLERRVTLPGLPEGVSDLGHHAGYYRLPNTHDARMFYFFFESRGKKEEPVVIWLTGGPGCSSELAVFYENGPFAIANNMSLVWNKFGWDKISNIIFVDQPTGTGFSYSSDDRDTRHDEAGVSNDLYDFLQVFFKKHPEFVKNDFFITGESYAGHYIPAFASRVHQGNKKNEGTHINLKGFAIGNGLTDPAIQYKAYTDYALDMNLIQKADYDRINKFIPPCEFAIKLCGTDGKASCMAAYMVCNTIFNSIMKLVGTKNYYDVRKECEGKLCYDFSNLEKFFGDKAVRQAIGVGDIEFVSCSTSVYQAMLTDWMRNLEVGIPALLEDGINVLIYAGEYDLICNWLGNSRWVHSMEWSGQKDFAKTAESSFLVDDAQAGVLKSHGALSFLKVHNAGHMVPMDQPKAALEMLRRFTQGKLKEAVPEEESSTTTFYTAM

SEQ ID NO: 21915 - protein, 394 aa, Pisum sativum
MEGGGGAPAADAVMEDAAPQQQEPQQQAAMGIENIPATLSHGGRFIQYNIFGNIFEVTAKYRPPIMPIGKGAYGIVCSAHNSETNEHVAVKKIANAFDNKIDAKRTLREIKLVRHMDHENVVAIRDIVPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEADLGFLNENAKRYIRQLPLYRRQSFQEKFPHVHPEAIDLVEKMLTFDPRQRITVENALAHPYLTSLHDISDEPVCTTPFSFDFEQHALTEEQMKELIYREALAFNPEYQQ

SEQ ID NO: 21916 - protein, 197 aa, Oryza sativa; identical to SEQ ID NO: 4995

SEQ ID NO: 21917 - protein, 79 aa, Zea mays
MAVTITWVKARQIFDSRGNPTVEVDVGLSDGSYARGAVPSGASTGIYEALELRDGGSDYLGLPLHAFQDSVLPLPPPML

SEQ ID NO: 21918 - protein, 1006 aa, Desulfovibrio vulgaris subsp. vulgaris (strain Hildenborough)
MDQQHLDGKVVERGKEFFRSISGEAPSIFNKGWWTGKVMDWAMQNEDFKVQLFRFVDVLPYLNTSESLLRHIREYFATEDADIPPVLKWGAGKAGIGGALTAKLMGMTIRSNIEGMARQFIIGDNSKEAVKGLAKLRKDGFTFTVDLLGEATVSEEESEAYAQGYHEVVDAIAREQEKWKALPGNGPVEGFDWGATPKVNVSIKPSALYSQAKPVDVEGSVRGILSRLVPIYRKVVAMGGFLCIDMEQLKYKEMTLELFKRLRSDPEFRHYPHLSIVLQAYLRDTEKDLDDLLHWARSEKLPIGIRLVKGAYWDYETVIAKQNGWEIPVWTDKPESDIAYEKLAHRILENSDIVYFACASHNVRTIAAVMETALALNVPEHRYEFQVLYGMAEPVRKGLKNVAGRVRLYCPYGELIPGMAYLVRRLLENTANESFLRQSFAEGAALERLLENPQKTLHRLLAARPEPRAVEPGPGGLPPFTNDAMIDFTVPDNRKAFVEALADVRSRFGQTVPLYIGGRDVTTADLIPTTNPAKPAEVVASICQAGRPEIDDAIAAAKKAALTWRDTSPADRAAYLRRAADICRKRIWELSAWQVVEVGKQWDQAYHDVTEGIDFLEYYAREMLRLGAPRRMGRAPGEHNHLFYQPKGIAAVIAPWNFPFAIAIGMASAAIVTGNPVIFKPSSISSRIGYNLAEVFREAGLPEGVFNYCPGRSSIMGDYLVEHPDISLICFTGSMEVGLRIQEKAAKVQPGQRQCKRVIAEMGGKNATIIDDDADLDEAVLQVLYSAFGFQGQKCSACSRVIVLDAIYDRFIERLVKAASSIHIGPSEDPSNYMGPVADATLQKNVSDYIRIAEEEGRVLLKRTDLPAEGCYVPLTIVGDIRPEHRIAQEEIFGPVLAVMRAATFDEALSIANGTRFALTGAVFSRSPEHLDKARREFRVGNLYLNKGSTGALVERQPFGGFAMSGVGSKTGGPDYLLQFMDPRVVTENTMRRGFTPIDEDDDWIV

SEQ ID NO: 21919 - protein, 434 aa, Neurospora crassa
MVSHSEPPKEDLSAVALEHTIDEANALINGTSDVPKIQELDASKLVVTLADPNARQVPDEATANAASETICTDHMVTVSYNVESGWGVPELKPYGPISLMPTASVLHYATECFEGLKVFRGFDGKLRLFRPNLNAKRLLMSTLRIALPGFDPVEVEKLIAKLVAVDGAKWLPKDRPGSFLYIRPAVIGTQPQLGVQAPKQALLFITVSFMPRMDSPAGGMRLHTNPEDMIRAWVGGFGYAKVGANYGPSLLATNEARARGFHQILWLYGKEAYCTEAGASNFFIVWRAKESEGGKLQLLTAPLDDKLILDGVTRRSVLELAKARLAGEVEVVERRYTIDEVIEADKEGRIVEAFAAGTAFFIAPVSQIHHRGTDVHIPLGENDSGVYTTKIKSWMKDIMYGNEQHEWGVVINEEDEAVAGQKRKREQNEEAKRE

SEQ ID NO: 21920 - protein, 356 aa, Schizosaccharomyces pombe
MFKSLVRKSSAFQPLKYGGKYTVTLIPGDGIGRETSNAVTEIFKTANVPIEFEEIDVTGMEKNNKSSGDALHEAIQSLKRNKVGLKGILFTPFEKGGHTSFNVALRKELDIYASLVLIKNIPGFKTRHDNVDFAIIRENTEGEYSGLEHQSVPGVVESLKIITEYKSKRIAQFAFDFALQNGRKSVTCIHKANIMKLADGLFRRTFYDVANGYDAITPKDLIVDNASMQAVSRPQQFDVLVMPNLYGSILSNIGSALVGGPGVIPGANFGRDYALFEPGCRHVGLSITGRGEANPTAAILSACLMLRHLGLKDYADLINAATYSVIEEGKTLTKDLGGSASTGDFTHAILERMESL

SEQ ID NO: 21921 - protein, 394 aa, Thermoanaerobacter tengcongensis
MDLKKEALKLHRENKGKIEVVSKVPVKNEEDLSLAYTPYVAEPCKEIEKDKDLVYEYTVKGHMVAVVTDGSAVLGLGNIGPYAALPVMEGKAVLFKEFGGIDAIPICLATQDVDEIIRTVLNIAPTFGGINLEDISAPRCFEIEKRLDEMLDIPVFHDDQHGTAIVTFAALVNALKIVKKSLYEIVAVVNGAGAAGVAISKFLVNAGVKDVIVCDRSGIIYEGRKDLDSSKQKIAKITNKKKIKGTLKEALEGADVFIGVSGPNLLTKEMVKKMAKKPIVFALANPVPEIHPEEAKEAGAYVVGTGRSDFPNQVNNVLAFPGVFKGALRVRATTINERMKLAAAYAIANTISEEELSSEYILPKPFDKRVAENVAYAVAKEAINTGVSRITKFD

SEQ ID NO: 21922 - protein, 465 aa, Corynebacterium efficiens YS-314
MNASPTVTDQLVQTRKFKGLRARHIHFIALGSAIGTGLFYGSAGAIQAAGPSVLLVYLLGGAVVYFMLRALGEMSVRHPVRGSFAVYTRAHLGGWAGYITGWMFAFEMLIVCLADLTAIGIYMKFWFPDTAQWVWVAATLLIVGGANLASVRWFGELEFVFTLIKVTAVIAMIVGGAAILAFGLGNSPEVSGISNLWEHGGFFPNGIEGMIAAFILVLFAFGGTEIIGVAGSEAEDPEKSIPKAVNTVPARILLFYVGAILVILALNPWQTITGEESPFVQIFSTLGVNWAAGLLNLVVITAALSAINADLFGAGRVLTGLAKENLAPKIMGRVAGNGVPIMTTVIMIIVLILGVVLNVILPERVFEIVASLATFATVYVWLMILLAQVASRRQMSAQEVAGLKFPVPFYPFGQYFAILFIAFTFGIMVWYDNYHLALGVGVGFLVVMTILYYATGRPKAIAPAQ

SEQ ID NO: 21923 - protein, 453 aa, Rhabdonia clavigera
KDTDVLALFRVSPQPGVDPIEASAAVAGESSTATWTVVWIDLLTACDLYRAKAYKVDAVPNTTDQYFAFISYDIDLFEEGSIANLTASIIGNVFGFKAVKALRLEDMRLPVAYLKTFQGPATGIICERERMDKFGRPFLGATVKPKLGLSGKNYGRVVYEGLKGGLDFLKDDENINSQPFMRWKERYLYSMEGVNRAIAGTGEVKGHYLNVTAATMEDMYERAEFAKQLGSVIIMIDLVIGYTAIQTMGIWARHNDMILHLHRAGNSTYSRQKIHGMNFRVICKWMRMAGVDHIHAGTVVGKLEGDPLMIRGFYNTLLLPYLKVNLIQGIFFEQDWASLRKVTPVASGGIHCGQMHQLLDYLGVDVVLQFGGGTIGHPDGIQAGATANRVALESMVLARNEGIDYVAEGPQILQDAAKTCGPLQTALDLWKDISFNYTSTDTADFVETPTANV

SEQ ID NO: 21924 - protein, 108 aa, Zea mays
  unsure (1)..(108): unsure at all Xaa locations
MLTLLFFSLGALLLIVLLFKFAFADGDFTLISKKHVKREAIQGKVVWITGASRGIGEILAKQFASLDAKLILSARNKAELDRVKXELKGKFAPEDVKGXPXXPPPPPS

SEQ ID NO: 21925 - protein, 457 aa, Sphacelaria plumigera
DYNVKDTDILALFRITPQPGVDPVEAAAAVAGESSTATWTVVWTDLLTACDIYRAKAYRVDPVPGTSDQFFAYVAYECDLFEEGSLANLTASIIGNVFGFKAVKALRLEDMRIPFAYLKTFQGPATGLIVERERLDKFGRPFLGATVKPKLGLSGKNYGRVVYEGLQGGLDFLKDDENINSQPFMRWKERFLYCMEGVNRAAAATGEVKGSYLNVTAATMEQIYERAEFAESVGTVIVMIDLVIGYSAIQTMAIWARKAQMILHLHRGGNSTYARQKNHGINFRVICKWMRMSGVDHIHAGTVVGKLEGGPLMVRGFYNTLLLTELKVNLAEGLFFDMDWASLRKCVPVASGGIHCGQMHQLLYYLGDDVVLRFGGGTIGHPDGIQSGATANRVALEAMVLARNEERDYVSEGPEILRVAAATCGPLKAALDLWKDITFEYTSTDTPDFVEVATGSN

SEQ ID NO: 21926 - protein, 879 aa, Saccharomyces cerevisiae
PRLTRRLTGFLPQEIKSIDTMIPLLSRALWNKHQVKKFNKAEDFQDRFIDHVETTLARSLYNCDDMVAYEAASMSIRDNLVIDWNKTQQKFTTRDPKRVYYLSLEFLMGRALDNALINMKIEDPEDPAASKGKPREMIKGALDELGFKLEDVLDQEPDAGLGNGGLGRLAACFVDSMATEGIPAWGYGLRYEYGIFAQKIIDGYQVETPDYWLNSGNPWEIERNEVQIPVTFYGYVDRPEGGKTTLSASQWIGGERVLAVAYDFPVPGFKTSNVNNLRLWQARPTTEFDLNKFNNGDYKNSVAQQQRAESITAVLYPNDNFAQGKELRLKQQYFWCAASLHDILRRFKKSKRPWTEFPDQVAIQLNDTHPTLAIVELQRVLVDLEKLDWHEAWDIVTKTFAYTNHTVMQEALEKWPRRLFGHLLPRHLEIIYDINWFFLEDVAKKFPKDVDLLSRISIIEENSPERQIRMAFLAIVGSHKVNGVVELHSELIKTTIFKDFIKFYGPSKFVNVTNGITPRRWLKQANPSLAKLISETLNDPTEEYLLDMAKLTQLEKYVEDKEFLKKWNQVKLNNKIRLVDLIKKENDGVDIINREYLDDTLFDMQVKRIHEYKRQQLNVFGIIYRYLAMKNMLKNGASIEEVARKYPRKVSIFGGKSAPGYYMAKLIIKLINCVADIVNNDESIEHLLKVVFVADYNVSKAEIIIPASDLSEHISTAGTEASGTSNMKFVMNGGLIIGTVDGANVEITREIGEDNVFLFGNLSENVEELRYNHQYHPQDLPSSLDSVLSYIESGQFSPENPNEFKPLVDSIKYHGDYYLVSDDFESYLATHELVDQEFHNQRSEWLKKSVLSLANVGFFSSDRCIEEYSDTIWNVEPVT

SEQ ID NO: 21927 - protein, 283 aa, Salmonella enterica
IGQALALLLKNQLPSGSELSLYDIAPVTPGVAVDLSHIPTAVKIKGFSGEDVTPALEGADVVLISAGVARKPGMDRSDLFNVNAGIVKNLVQQIAKTCPKACVGIITNPVNTTVAIAAEVLKKAGVYDKNKLFGVTTLDIIRSNTFVAELKGKLPTEVEVPVIGGHSGVTILPLLSQIPGVSFTEQEAAELTKRIQNAGTEVVEAKAGGGSATLSMGQAAARFGLSLVRALQGEKDVVECAYVEGDGQYARFFSQPLLLGKNGVEERKSIGTLSAFEQHSLDA

SEQ ID NO: 21928 - protein, 174 aa, Triticum aestivum
MAPAVMASSATTVAPFQGLKSTAGLPVSRRSRGSLGSVSNGGRIRCMQVWPIEGIKKFETLSYLPPLSTEALSKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 21929 - protein, 160 aa, Triticum aestivum
  unsure (1)..(160): unsure at all Xaa locations
MAPTVMASSATSVAPFQGLKSTAGLPVSRRSNGASLGSVSNGGRIRCMXVWPIEGIKKFETLSYLPPLSTEALLKQVDYLIRSKWVPCLEFNKXGFNXPLTTTQXLGYYDGRYWDNVESLPXFRVXPNAKXNXFKQGXXEVKKRXYPDPXCPESPEPHAL

SEQ ID NO: 21930 - protein, 306 aa, Triticum aestivum
  unsure (1)..(306): unsure at all Xaa locations
YGREEVVTSLSHVPAVCSKFVAGITEDPAIQNIDKLNGVNELDVVDYIEXDIYKFYKVAENECRAKDYMDSQVEINAKMRGILIDWILEVHQKFDLMPESLYLTVYIIDMYLSLQTVLRRELQLVGVSALLIACKCXVASPAEVLAVVLLSDSAVSREQILKMEKAILNMLEWXNLTVPTPYVFLVRFAKAASSSDQKNDKEMENTVFFFAELALLQYGLVQSKPSMVAAAAVYAARLTLKKTPLWTDTLKHHTGFTEAQLMEAAKILVASHSTAPDSKLKVVYKKYSSEKLGGVALRPPATDFCK

SEQ ID NO: 21931 - protein, 245 aa, Zea mays subsp. huehuetenangensis
SIRNNPVQNKLMNGEDPINNNHAQTAGGLDVRLATSSSSRDPSPSDEDMDGEVEILGFKMPTEERVRKRKESNRKSARRSRYRKAAHLKELEDQVAQLKAENSCLLRRIASLNQKYNDANVDNRVLRADMETLRAKVKMGEDSLKRVIEMSSSVPSSMPISAPDPQSDAPVQVPVPPPIRDSIVGYFSAPAADDDASVGNGFLRLQAQEPASMVVGATLSATEMNRVAAATHCAGAMELIQTAMG

SEQ ID NO: 21932 - protein, 637 aa, Nostoc sp. PCC 7120
MRTQDRVQVNSIAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKSL

SEQ ID NO: 21933 - protein, 332 aa, Saccharomyces cerevisiae
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEVKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLDKETTYDEIKKVVKAAAEGKLKGVLGYTEDAVVSSDFLGDSHSSIFDASAGIQLSPKFVKLVSWYDNEYGYSTRVVDLVEHIAKA

SEQ ID NO: 21934 - protein, 168 aa, Staphylococcus aureus subsp. aureus Mu50
MGEHQNVKLNRTVKAAVLTVSDTRDFVTDKGGQCVRQLLQADDVEVSDAHYTIVKDEKVAITTQVKKWLEEDIDVIITTGGTGIAQRDVTIEAVKPLLTKEIEGFGELFRYLSYVEDVGTRALLSRAVAGTVNNKLIFSIPGSTGAVKLALEKLIKPELNHLIHELTK

SEQ ID NO: 21935 - protein, 281 aa, Azotobacter vinelandii
MSQERRYSFEFFPTKTEAGHEKLMNVARRLAGCDPDFFSCTYGAGGSTRDRTLNTVLQLDGEVKVPTAPHLSCVGDSRAELRSLLNTYKDAGIRRIVALRGDLPSGMGLANGELRHASDLVEFIRAETGGHFHIEVAAYPEMHPQARNLEDDLARFAAKMKAGADSAITQYFFNADSYFHFVERVRKLGVEQPIVPGIMPITNYSKLARFSDACGAELPRWVRKQLEAYGDDLESIQAFGEQVVTAMCEKLLEGGAPGLHFYTLNQAEPSLAIWNNLGLPR

SEQ ID NO: 21936 - protein, 414 aa, Callithamnion collabens
LQLAVAGESSTATWTVVWTDLLTACDLYRAKAYKVDAVPNTSDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEAVNRSIAATGEVKGHYMNVTASTMEDMYERAEFAKQLGTVIVMIDLVIGYTAIQSMGIWARKNDMILHLHRAGNSTYSRQKIHGMNFRVICKWMRMAGVDHIHAGTVVGKLEGDPLMIKGFYDTLLVSHLDINLPQGIFFEQDWASLRKVTPVASGGIHCGQMHQLLDYLGNDVVLQFGGGTIGHPDGIQAGATANRVALETMVIARNEGRDYVAEGPQILRDAAKDCGPLQTALDLWKDITF

SEQ ID NO: 21937 - protein, 515 aa, Phaseolus vulgaris
MASMASIGSLNVPCSSSSSSSNGGRKILPRALSFSASQLYGDKISTDSVSVAPKRVRNPVVVSPKAVSDSQNSQTCLDPDASKSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEYLVLAGDHLYRMDYEKFIQVHRESDADITVAALPMDENRATAFGLMKIDEEGRIIEFAEKPKGEQLKAMKVDTTIFGLDDERAKEMPYIASMGIYVVSKNVMLNLLREKFPAANDFGSEVIPGATSIGLRVQAYLYDGYWEDIGTIEAFYNANLGITKKPVPDFSFYGRSSPIYTQPRYLPPSKMLDADVTDSVIGEGCVIKNCKIHHSVVGLRSCISEGAIIEDTLLMGADYYETDADKRFLAAKGSVPIGIGRNSHVKRAIIDKNARIGENVKILNSDNVQEAARETDGYFIKSGIVTVIKDALIPSGTVI

SEQ ID NO: 21938 - protein, 455 aa, Oryza sativa (japonica cultivar-group)
MEWDLKMPPAASWELADELENSGGGGVPAAVSSSSAAVGGGVNAGGGGRQECSVDLKLGGLGEFGGGGAQPRVAVAGEPAKGKGPAAAATGAAAAASSAPAKRPRGAAAAGQQQCPSCAVDGCKEDLSKCRDYHRRHKVCEAHSKTPLVVVSGREMRFCQQCSRFHLLQEFDEAKRSCRKRLDGHNRRRRKPQPDPMNSASYLASQQGARFSPFATPRPEASWTGMIKTEESPYYTHHQIPLGISSRQQHFVGSTSDGGRRFPFLQEGEISFGTGAGAGGVPMDQAAAAAAASVCQPLLKTVAPPPPPHGGGGSGGGKMFSDGGLTQVLDSDCALSLLSAPANSTAIDVGGGRVVVQPTEHIPMAQPLISGLQFGGGGGSSAWFAARPHHQAATGAAATAVVVSTAGFSCPVVESEQLNTVLSSNDNEMNYNGMFHVGGEGSSDGTSSSLPFSWQ

SEQ ID NO: 21939 - protein, 348 aa, Shigella flexneri 2a str. 301
MEFFKKTALAALVMGFSGAALALPNITILATGGTIAGGGDSATKSNYTAGKVGVENLVNAVPQLKDIANVKGEQVVNIGSQDMNDNVWLTLAKKINADCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKNGTAVVRSSRVPTGATTQDAEVDDAKYGFVASGTLNPQKARVLLQLALTQTKDPQQIQQIFNQY

SEQ ID NO: 21940 - protein, 364 aa, Zea mays
MEQEPHRPMELPPGFRFHPTDEELITHYLARKAADARFAALAVAEADLNKCEPWDLPSLARMGEKEWYFFCLKDRKYPTGLRTNRATEAGYWKATGKDRDVFRGKALVGSKKTLVFYTGRAPRGEKSGWVMHEYRLHAKLHGHGHGQGAAVVVVPKAAGSKNEWVLCRVFKKSLVVGGAAAAAAPTAGKRGGTETSSNYKTGDVEAIAHLPPLMDVSGSGSGAGAAAAAAAHVTCFSDALEGQFLDQTTTTPPPEAATAATDDDGHLGALGASSSPFQLPGFAHYYYGGGPPHLHQHHGAASLVQLLEGSVPPCNKGGERERERLSASQDTGLTSDVNPEISSSSGQRFDHDHDHDHHLCCWGY

SEQ ID NO: 21941 - protein, 247 aa, Saccharomyces cerevisiae
MVHLGPKKPQARKGSMADVPKELMQQIENFEKIFTVPTETLQAVTKHFISELEKGLSKKGGNIPMIPGWVMDFPTGKESGDFLAIDLGGTNLRVVLVKLGGDRTFDTTQSKYRLPDAMRTTQNPDELWEFIADSLKAFIDEQFPQGISEPIPLGFTFSFPASQNKINEGILQRWTKGFDIPNIENHDVVPMLQKQITKRNIPIEVVALINDTTGTLVASYYTDPETKMGVIFGTGVNGAYYDVCSDI

SEQ ID NO: 21942 - protein, 240 aa, Pseudomonas aeruginosa UCBPP-PA14
MELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGNGAYVAPTVFTDCSDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 21943 - protein, 403 aa, Zea mays
MATALGGGPNPTADAMEVDPPRASADEKHVATIIAGGSDAVTGHIISTTIGGKNGEPKRTISYMAERVVGTGSFGVVFQAKCIETGETVAIKKVLQDKRYKNRELQIMRSIDHCNVISLKHCFFSTTSRDELFLNLVMEFVPESLYRVLKHYKDMKQRMPLIYVKLYMYQIFRGLAYIHTVPGICHRDIKPQNILVDPLSHQVKVCDFGSAKILIKGEANISYICSRYYRAPELIFGATEYTTSIDIWSAGCVLAELLLSQPLFPGESAVDQLVEIIKVLGTPTREEIRCMNPNYTEFKFPQIKACPWHKIFHKRMPPEAIDLVSRLLQYSPNLRCSALEACAHSFFDELRESHARLPNGRPFPPLFNFKQELANAPPELVSRLLPEHARRHSGFGSLFGSGP

SEQ ID NO: 21944 - protein, 179 aa, Triticum aestivum
  unsure (1)..(179): unsure at all Xaa locations
QVLRLATQPSILVAATTTTTTTTIQSVKARQIFDSRGNPTVEVDIGLSDGSFXRGAVPSGASTGIYEALELRDGGSDYLGKGVLXAVNNVNAIIGPALIGKDPTEQTDIDNFMVQQLDGTSNEWGWCKQKLGANAILAVSLAVCKAGAMVKKIPLYQHIANLAGNKTLVLPVPAFNVIN

SEQ ID NO: 21945 - protein, 149 aa, Zea mays
HFLYVVIGDDCQLGHHLDDTWVAYAGSGAGNRPPPILSWQQLASGTPGGRFSHSCLLVGDTLVLFGGITDQGQRLNDTWTGQIICEEPRRPRISWRLLEVGRLAPPPRGAHAACCVDDKFIVIHGGIGLYGSRLGDTWLLDLSNGLQSG

SEQ ID NO: 21946 - protein, 455 aa, Gelidium chilense
  unsure (1)..(455): unsure at all Xaa locations
VVNETDVLALFRVSPQPGVDPVEASAAVAGESSTATWTVVWTDLLTACDLYRAKAYKVEAVPNTTDQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLKGGLDFLKDDENINSQPFMRWKERFLYSMEGVNRSIAASGEXKGHYMNVTAATMEDMYERAEFAKQLGTVIXMIDLVIGYTAIQTMAIWARKNDMILHLHRAGNSTYSRQKNHGMNFRVICKWMRMAGVDHIHAGTVVGKLEGDPEMIRGFYNTLLLTHLDXNLVQGIFFEQDWASLRKVTPVASGGXHXGQMHQLLDYLGNDVVLQFGGGTIGHPDGIQAGATANRVALEAMVIARNEGRNYVAEGPQILRDAAKTCGPLQTALDLWKDIXFNYTSTDTADFVETPTANV

SEQ ID NO: 21947 - protein, 312 aa, Pseudomonas fluorescens
MYLVCGEALFDFFSEEDASGQASKVTYKAIAGGSPFNVAVGLRRLGIEAGLFGGLSSDFLGRRLLQVLKDEGVSERFLVEFAAPTTLSMVAVGADGSPQYNFRGEGCADRLLEVAHLPVLGDEVRGLHIGSFSLVVQPIGDTLLSLVKRESGKRLISLDPNVRLNPQPDIQLWRDRVAELAKHADLIKVSDEDLHLLYPGQSPESVLQGWLQHRCQLVFLTRGGDGASVFSRQHGTWSQPAQRVVMADTVGAGDTFQAALIAWLTEHQLDSVQGLQQLTRVQIDAMLGFAIRAAALTCGKTGPDLPYRQQLG

SEQ ID NO: 21948 - protein, 57 aa, Pennisetum glaucum
KGKLPKDARLSLMNWWNTHYSWPYPTEEDKRRGRHDGLDQRQINNWFVNQRKRHWKP

SEQ ID NO: 21949 - protein, 476 aa, Glycine max
  unsure (1)..(476): unsure at all Xaa locations
MATATLSPADADKLSNLKSSVAALSQISENEKNGFTSLVARYLSGEAQHVEWSKIETPTDEVVVPYDSLAPTPDGSLEXKNLLDKLVVLKLNGGLGTXTMGCTGPKSVIEVRDGLTFLDLIVVQIENLNSKYGSNVPLLLMNSFNTHDDTQKIVEKYKNSNIEIHTFNQSQYPRLVVDDFLPFPSKGQTGRDGXYPPGHGDVFPSLVNSGKLDVLLSQGKEYVFVANSDNLGAVVDLKILNHLIEHKNEYCMEVTPKTLADVKGGTLISYEGRVQLLEIAQVPDEHVSEFKSIEKFKIFNTNNLWVNLKAIKRLVEADALKMEIIPNPKEVDGVKVLQLETAAGAAIRFFDKAIGINVHRSRFLPVKATSDLLLVQSDLYTLQDGLVIRNQARANPENPSIELGPEFKKVSNFLSRFKSIPSIVELDSLKVAGDVWFGAGVILKGKASILAKPGVKLEIPDGAVIADKEINGPEDL

SEQ ID NO: 21950 - protein, 215 aa, Rhizobium etli
MPGPHLVAGHKVREAIAPYEALRWLHVGDSKMIVAVPNSGASRINQSGVEALREFPNFPIGGILFKDIAPMLAGRGALGEVVSTVASQVSGTEIDAILAVDARGFILGASLADRLGCGFIMVRKPGKLPGDVLSFEYSCEYCSGTLEVTAGLIGDGLRCLIADDLLATGGTARATGNFVKSQGGEIAGYAFILEIEVLKGRRQLDDAPVISAMTC

SEQ ID NO: 21951 - protein, 333 aa, Saccharomyces cerevisiae
MSEPSEKKQKVATSSLEQLKKAGTHVVADSGDFEAISKYEPQDSTTNPSLILAASKLEKYARFIDAAVEYGRKHGKTDHEKIENAMDKILVEFGTQILKVVPGRVSTEVDARLSFDKKATVKKALHIIKLYKDAGVPKERVLIKIASTWEGIQAARELEVKHGIHCNMTLLFSFTQAVACAEANVTLISPFVGRIMDFYKALSGKDYTAETDPGVLSVKKIYSYYKRHGYATEVMAASFRNLDELKALAGIDNMTLPLNLLEQLYESTDPIENKLNSESAKEEGVEKVSSINDEPHFRYVLNEDQMATEKLSDGIRKFSADIEALYKLVEEKM

SEQ ID NO: 21952 - protein, 223 aa, Xanthomonas axonopodis pv. citri str. 306
MQPTAIAPSILSADFARLGEEVNNVLKAGADWVHFDVMDNHYVPNLTIGPMVCQALRKHGITAPIDVHLMVEPVDRIVPDFANAGATTISFHPEASRHVHRTIQLIKSHGCQAGLVLNPATPVDILDWVLPELDLVLVMSVNPGFGGQAFIPSALDKLRAIRSKIDATGKPIRLEIDGGVKADNIGAIAAAGADTFVAGSAIFNAPDYAQVIAQMRAAVDAVR

SEQ ID NO: 21953 - protein, 527 aa, Neurospora crassa
MSTPQKTAGGNNAYHNFYNDFLHIKDPNERRRLALAEVDRAPFGWYHVRAVAVAGVGFFTDSYDIFTVSLLTLMLGILATSAGTVIGQVGFGAAADVFGRLGLRVTFHQHHRYHYLLACSYDYPLSSIITSEFATTKWRGAMMGAVFAMQGLGQLAAAFVMLFVTLGFKKSLEAAPTLASCTGDCAVAVDKMWRTVIGVGAVPGCIALYYRLTIPETPRYTFDVKRDVEQASDDIEAFKTGKPKGQPDEATRIVAKQEAEKEMEIPKASWGDFFRHYSKRKNAMLLAGTALSWCFLDIAYYGVSLNNATILNVIGYSTTGAKNTYEILYNTAVGNLIIVLAGAVPGYWVTVFTVDTVGRKPIQFMGFGILTILFVVMGFAYKHLSPHALLAIFVLAQFFFNFGPNATTFIVPGEVFPTRYRSTSHGLSAAMGKIGSIIGQGAIAPLRTRGAVKGGNPNPWMNHVLEIYALFMLLGVGTTFLIPETKRKTLEELSGEFDMSGEEEAQRDTTLTEHKTEAPTSSAAVNA

SEQ ID NO: 21954 - protein, 464 aa, Glycine max
MVFEGDSASSYGISSFVCFQYFGFVTRVLASSQPCFGFNMANTLYNGATCRIPLRDESLAFSRHVSRSLSFLLKTRAGKQSYAFAVKASSHSDFDVDLSLSPRVNAVKPSKTVAISDHATALFQAGVPVIRLAAGEPDFDTPAPIAEAGINAIREGYTRYTPNAGTMELRQAICRKLKAPFWVSYPEMARLADATPVILPTLISDNFLLDPKLLESKITERSRLLILCSPSNPTGSVYPKELLEEIARIVAKHPRLLVLSDEIYEHIIYAPATHTSFASLPGMWDRTLTVNGFSKAFAMTGWRLGYIAGPKHFVAACGKIQSQFTSGASSIAQKAAVAALGLGHAGGEAVSTMVKAFRERRDFLVKSFREIDGVKISEPQGAFYLFLDFSFYYGREAEGFGKIEDSESLCRYLLDVGQVALVPGSAFGDDTCIRISYAESLTTLQAAVERVKRALIPLSSAALV

SEQ ID NO: 21955 - protein, 523 aa, Aspergillus phoenicis
MRITSAIASLLLVGTATSLQNPHRRAVPAPLTHRSVASRAVPVERRSNDFEYLTNKTARFLVNGTSIPEVDFDVGESYAGLLPNTPTGNSSLFFWFFPSQNPDASDEITIWLNGGPGCSSLDGLLQENGPFLWQPGTYKPVPNPYSWTNLTNVVYIDQPAGTGFSPGPSTVNDEEDVAAQFNSWFKHFVDTFDLHGRKVYITGESYAGMYVPYIADAMLNEEDTTYFNLKGIQINDPSINSDSVMMYSPAVRHLNHYNNIFRLNSTFLSYINGKADKCGYNAFLDKAITYPPPTPFPTAPEITEDCQVWDEVVMAAYDINPCFNYYHLIDFCPYLWDVLGFPSLGFGPDNYFNRSDVQKILHVPPTDYSVCSETVIFANGDGSDPSSWGPLPSVIERTNNTIIGHGWLDYLLFLNGSLATIQNMTWNGKQGFQSPPVEPLFVPYHYGLAELYWGDEPDPYNLDAGAGYLGTAHTERGLTFSSVYLSGHEIPQYVPGALTASWSSCLVELIVFPRRGTTPLNFS

SEQ ID NO: 21956 - protein, 344 aa, Nitrobacter winogradskyi
IGCHTCSIACKNIWTDRKGTEYMYWNNVETKPGTGYPTRWEDQTKYRGGWVVDGQRQKSLRLRLQGKWGTLTNIFYNPYLPTLDDYFEPWTYDYQNLINAPLADEQPTARAISMVTGKYMDTIEAGPNWDDDLGGSQVYANNDPNFDGASDEEMRQINEINSTVFFHLPRICNHCLNPGCVAACPQGALYKRGEDGVVLVSQERCRAWRMCVSGCPYKKTYFNWSTGKAEKCILCYPRLESGQPPACFHSCVGRIRYIGLVLYDADAIEETAKSPQDQLVMAQRNIIKDPFDPEIIAAARANGIPDSKIEAAQKSPVFQFVKKWGIALPLHPEFRTLPMLFYVP

SEQ ID NO: 21957 - protein, 270 aa, Populus tremula x Populus tremuloides
MGRSPCCEKAHTNKGAWTKEEDDRLVAYIRAHGEGCWRSLPKAAGLLRCGKSCRLRWINYLRPDLKRGNFTEAEDELIIKLHSLLGNSRWSLIAGRLPGRTDNEIKNYWNTHIRRKLLNRGIDPATHRPLNEPVQEATTTISFTTTTTSVEEESRGSIIKEEIKEKLISATAFVCTEAKTQVQERCPDLNLELGISLPSQNQPDHHQPFKTGGSRSLCFACSLGLQNSKDCSCNVIVSTVGSSGSTSTKNGYDFLGMKSGVLDYRSLEMK

SEQ ID NO: 21958 - protein, 489 aa, Nitrosospira sp. 40KI
  unsure (1)..(489): unsure at all Xaa locations
MSEELKGEARYKSGVMPYKKMGYWDSDYVPKDTDVIALFRITPQEGVDHEEAAAAVAGESSTATWTVVWTDRLTACELYRAKAYRSELVPNTGPGTKNEAQYFAYIAYDLDLFEGGSIANLTASIIGNVFGFKAVKALRLEDMRIPVAYLKTFQGPATGIVVERERLDKFGRHXLGATTKPKLGLSGRNYGRVVYEGLKGGLDFMKDDENINSQPFMHWRDRFLYCMEAVNKASAATGEVKGHYLNVTAGTMEEMYERAEFAKSLGSVVVMIDLVIGYTAIQSMAKWSRKNDMILHLHRAGNSTYSRQKNHGMNFRVICKWMRMAGVDHIHAGTVVGKLEGDPLMIKGFYDTLRDTHSAKNLETGLFFDQDWASLNKVMPVASGGIHAGQMHQLLDYLGEDVILQFGGGTIGHPMGIQAGAVANRVALEAMILARNEGRDYVKEGPQILQTAAKWCTPLKQALDTWKDITFNYESTDTADFVPSTTASV

SEQ ID NO: 21959 - protein, 187 aa, Escherichia coli O157:H7 EDL933
MILLIDNYDSFTWNLYQYFCELGADVLVKRNDALTLADIDALKPQKVVISPGPCTPDEAGISLDVIRHYAGRLPILGVCLGHQAMAQAFGGKVVRAAKVMHGKTSPITHNGEGVFRGLANPLTVTRYHSLVVEPDSLPACFEVTAWSETREIMGIRHRQWDLEGVQFHPESILSEQGHQLLANFLHR

SEQ ID NO: 21960 - protein, 295 aa, Vibrio parahaemolyticus RIMD 2210633
MKSRIEQALASAPEALSKQLAPIVLADDFDATLSAQQFEQLLSATSLSDKELRVALLPFAAAYSYAPISEFYVGAIVRGLSGRLYFGANMEFFGVQLGQTVHAEQSAISHAWMKGEHGVKDITINFSPCGHCRQFMNELSTAKELKVQLPERDEKSLHEYLPEAFGPADLGIESGLMAEVKHQFVCDDKDALIQQAVEAMNMSHAPYTNNLSGLALELANGRVFKGAYAENAAFNPSLPPLQVALIQVLLAGETFDSIKAAALVENSEGKISHLADTQSTLEALNPDIPVSFVNV

SEQ ID NO: 21961 - protein, 338 aa, Aspergillus oryzae
MATPKVGINGFGRIGRIVFRNAIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 21962 - protein, 569 aa, Cyanidioschyzon merolae
MMTTGSYALLDTLVSLGVRHVFGYPGGAILPIYDELYHWEKKGLIQHYLVRHEQAAAHAADAYARTTGQVGVCFATSGPGATNLVTGIATACMDSVPLLVITGQVSRAFIGTDAFQETDIFGITLPIVKHSYLVRDARDISRIIVEAFTIAKHGRPGPVLVDIPKDVGLEEIDYERCVKVNIPGCRPILPPTTKQIEQMLMMLQSSRQPLLYVGGGAQAASQELYQLATQFQIPVTTTLMGKGCFDETHPLYLGMLGMHGTAYANFAVSECDLLIALGARFDDRVTGKLDEFASSAQVIHIDIDAAEIGKNRIPQLAICSDVKLVLQHFLAATSIAPNLVANDETYAWRKRIARWKHDYPLLIPRPSSYLSAQEILNALAQLAPHAIYSTDVGQHQMWAAQLLRVQPRQWLSSSGLGTMGYGLPAAIGAAIAHQGNRSIICISGDASFQMNLQELATISQYKLKIKIFLLNNGWQGMVRQWQQAFYGERYSHSSMQEGQPDWMLLAQAYGIKGICLDSREHLIEQLESILHLDESVLVNCLIQPDENCYPMVAPGKSNSQMLGLLSSST

SEQ ID NO: 21963 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 21964 - protein, 330 aa, Oryza sativa
MSFGAVDVDDGGAAATAAASGGEEVRAMPAEVSWEMLDKSRFFLLGAALFSGVSAALTRAVVLKTHLQVSPPPAAAASTTAAAILRRHGPRGFYRGFGASLAGTVPARAVYMAALEATKSAVGSAAVRLGVAEPAASAAASAAGGVSAAVAAQVVWTPVDVVSQRLMVQTAAAGPPYRGGADALRRILRADGVRGLYRGFGVSVLTYAPSSAAWWASYATAQRLIWRALGPAHHDSRASVVAVQGASAAAAGGAAALVTMPLDTVKTRLQVMDGGGASLASEARALVREGGWGACYRGLGPRWASMSLSAATMVTAYEFLKRLSTKDTSL

SEQ ID NO: 21965 - protein, 504 aa, SYNECHOCOCCUS SP. WH 8102
MSSGLGATPLFMEVLPRFASNPFRLLTTPAPLQQALDQEYAQMDFQPVQEKLERDPGYQADVIAGISSVRSRTPDLRYAPMSEGLMGLAYAQLTPLMEEWAGQPLERSFGYGVRSYGPGSWLHMHRDRVDTHVVSCIVHVADQSNIPWALDFVDHEAEHHQVLFNPGTMLFYESLCPHGRASEFDGNFYRNMYFHWRPKVWNPGLYQDLACKFANVEEARKSNQQLKDIASIPETWREWLRLNQERGCDREGMLERAMAHGFSRQALEQVLDASRVSLSVATPVQSAPTTRSNFLEWFEAPLTRPEHQPRAWRLDTPLAQVYELPGLLHRDECDEVMEAINGSLQPSTVTRGASDYRTSRTCHLRQNHPELAERLDERFAALLGVDSGLSEPIQGQRYDPGEYFKEHTDWFGPGTKEFTEHTACGGQRTWTLMVYLNAVERGGETCFKRLGRCFTPAPGLALAWNNLQADGTPNPFTLHEAMPVEVGSKWVITKWFRQRAGRND

SEQ ID NO: 21966 - protein, 296 aa, Glycine max
  unsure (1)..(296): unsure at all Xaa locations
MAASSLNHKFHNHARSNSLPSKPHPLILQCNERLSRLGAYDTISSSLLRQNLTNLLDLHGCIEKLVQLPLTQQALVQECQEKWVDDLLDGSLRLLDXCTATKDALLHTKECTRELQSXLRRRRGGEVELTLEVKKFLTSRKVVRKAIFKALENLKGNANKGNLAITNYKDYQTMALVNLLKEAEVITFSTFESLLNFFSGSTQAKRISSWALVSKLMHNKRVGYAQGADENEFAKVDAAFQLFAFNMSTKSNDDISDLLKKLENLGTCIPDLEEGLESLFRRLIKIRVALLNILNH

SEQ ID NO: 21967 - protein, 311 aa, Magnetospirillum magnetotacticum
MTDGRDNTAEALARQVLRVRLAQMLINEALKAKKFRVPVHLALGHEAIAVAVGAAMAEGDSLFLTHRNIHYNIARATSLAAEVSELALRPDGLAGGRLGSMNMSNPGRGLIYTSSILGNDLCVAAGAAMAETVLGSGAVPFVVTGDGALEEGVFFESLELARSGDAPLVVVVENNGWSLATRIEERRCPIHVDRVAAAFDLPYGRLSGNDVATYAAELIRLRGEALARRRPVVVEVDLATLGDWLMPHPDFPAGKYINYHHGAAPEVTPSDWPVIRDNAEDPVFVLTQRHDADWLRGQSAALLTSLREELA

SEQ ID NO: 21968 - protein, 201 aa, Coxiella burnetii RSA 493
MLLMIDNYDSFTYNLARYFEELGAAVSVYFNDKISLADIAALNPKQIVISPGPGRPEEAGITLPMIKAFSGKIPLLGICLGHQAIAQAFGAKIVLAEKIMHGKTSIIHHSGKGVFNGINDSFVATRYHSLIIERESLPAEFEITAWTNPNQEIMGIRHAHHSLEGVQFHPESVLTQHGHRLLKNFLNPISQRGHHLCLKSH

SEQ ID NO: 21969 - protein, 335 aa, Thermotoga neapolitana
STFVAGLEKLKKGEIEPYGVPLAGELPIDFKDIRIVGSYDVDRAKIGKKLSEVVSQYWCDVNSLSDDPVVSTGVHLGSVKNLPIEAEGLEDSMTLKEAIERLVDEWSKLDPDVIVNTCTTEAFKPFGNKEELLKAIENNDKERLTATQVYAYAATLYAKKRGGAAFVNVIPTYIANDPAFVELAKWNNLVVFGDDGATGATPFTADVLSHLAQRNRYVKDVAQFNIGGNMDFLALTDEGKNKSKEFTKSSIVKDILGYDAPHYIKPTGYLEPLGDKKFIAIHIEYTSFNGATDELMISGRINDSPALGGLLVDLVRLGKIALNRKEYGTVYPVNA

SEQ ID NO: 21970 - protein, 97 aa, Zea mays
  unsure (1)..(97): unsure at all Xaa locations
MAVTITWVKARHIFYSRCNPTVLVDVCLIYGSYSRGVLPIGAFTGIYDALQLRDXGSDYLGTGVLKAVSNVNYIFGPSIVVKDLTEQVEIYNFMVHH

SEQ ID NO: 21971 - protein, 373 aa, Brucella melitensis 16M
MWQPAVSSPASLMLVSSHSPGTMQVRQRRSNSMAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 21972 - protein, 402 aa, Bacillus anthracis str. Ames
MHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 21973 - protein, 323 aa, Glycine max; identical to SEQ ID NO: 11052

SEQ ID NO: 21974 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 21975 - protein, 472 aa, Streptomyces avermitilis MA-4680
MAGIRMGEGVLRRKPIEQIEETEAGTQLERTLGLWQLTAIGVGGIIGAGIFTLAGTVANGTAGPAVLVSFLIAGFASAAAALSYAEFAGLIPKAGSAYTYGYAVLGELAGWFIGWDLLLEYTAIVAVVAIGISGYFGFLVGELGADLPAWMLGAPGTGGGHRVDLFAAILCLLIAYLLNLGIKSAARFETVVVALKVLVVLLVIGVGVFHIDTGNYHPFFPYGVGGAFTGAATVFFAVFGYDAMSTAAEESKDAQRHMPKAIIYSLAISMVLYVAACLVLTGMQNYKDIDKESGFSTAFKSVGLGGLADVIAVGAIIGILTVMFTFMLGVTRVWFSMSRDGLLPKWFAKTHPTRHVPTRVTWIVGFASAAIAGFLPIGQAAELTNIGILLAFVVVCVAVIVLRYRQPDLPRTFRTPWMPYVPALGVIFSIWLITFLQWRTWVRFGVWLVIGLVIYFGYSYKRSELAKGVNSP

SEQ ID NO: 21976 - protein, 245 aa, Houttuynia cordata
MGRGRVQMKRIENKINRQVTFSKRRMGLLKKAHEISVLCDADVALIVFSTKGKLYEYATDSSMTKILERYERYSFAEREFALADNESEGAWSLEFGKLKARVEALQKTHRHYLGEDLDSLKVKELQHLEQQLDSALKHVRLRKNQVIQETISELQKKEKALQEQNNMLEKKVQEKQKAKAQQTRWENQSQNQNSAPFLFSLPLPNLNMGTYHQENGTEIREQEAARPLAHSNSQMPAWMLRHASE

SEQ ID NO: 21977 - protein, 333 aa, Rhodobacter sphaeroides
MKPFPTHPDAIPAELQDVMDRLGSVAIEVANRIARGGIDEDLAGLCGTNTDGDGQKALDVIADDAFRVALEGSAVRFYASEEQDTAVTLNEAGTLALAIDPLDGSSNIDTNLSVGTTFAIWPAAPRPNPSFLRLGSELIAAGYVIYGPQVCMMVSFGKGTQKYVLDPGSRSFVLVDRAVKVPPSSTEFAINASNYRHWPKPIRAYIDDCVAGTEGPRGRNFNMRWLASLVAETHRILARGGVFLYPRDSRKGYEQGRLRYLYECAPIAFVITQAGGGATDGENPILGQTPSRLHARTPFVFGSAEKVARITAYHDLPEQETSALFGNRGLFRS

SEQ ID NO: 21978 - protein, 373 aa, Clostridium thermocellum ATCC 27405
MKSTMGIILTGGKNDRLKELAEMRSSTAVPIGGKYRVIDFVLSNMVNSGIKNIGVLTQYSFRSLMDHLGSGKEWDLDRRNEGLFIFPPYLAGEHSGWYQGSADAMYHNITFLKRSYEEYVLVAQGNCVYKMLFDDMLDYHIKKNADITIAYRDMSDFPREELSFMGVMTMDENRRVVDFKEKHKNPESTICSMGIYILKRELLIALLEECNSHGKYDFVKDVIINKLPTLNIYGYKFEGYWRNLNSINAYYRINMEMLNPEIRYQLFEQHGKVYTKVKDEPPAKYNEEAEVRNSIIADGCIIEGTVINSVLFRGVTIKRNAVVKDCIIMQDSVIEEDVDIESLIIDKNVYLSKGIRLKGMVNFPITIGKNAVI

SEQ ID NO: 21979 - protein, 540 aa, Triglochin maritimum
MELITILPSVLPNIHSTATVLFLLLLTTALSFLFLFKQHLTKLTKSKSKSTTLPPGPRPWPIVGSLVSMYMNRPSFRWILAQMEGRRIGCIRLGGVHVVPVNCPEIAREFLKVHDADFASRPVTVVTRYSSRGFRSIAVVPLGEQWKKMRRVVASEIINAKRLQWQLGLRTEEADNIMRYITYQCNTSGDTNGAIIDVRFALRHYCANVIRRMLFGKRYFGSGGEGGGPGKEEIEHVDATFDVLGLIYAFNAADYVSWLKFLDLHGQEKKVKKAIDVVNKYHDSVIESRRERKVEGREDKDPEDLLDVLLSLKDSNGKPLLDVEEIKAQIADLTYATVDNPSNAVEWALAEMLNNPDILQKATDEVDQVVGRHRLVQESDFPNLPYIRACAREALRLHPVAAFNLPHVSLRDTHVAGFFIPKGSHVLLSRVGLGRNPKVWDNPLRFDPDRHLHGGPTAKVELAEPELRFVSFTTGRRGCMGGPLGTAMTYMLLARFVQGFTWGLRPAVEKVELEEEKCSMFLGKPLRALAKPRQELLQSF

SEQ ID NO: 21980 - protein, 441 aa, Gelidium pteridifolium
TPQPGVDAIEASAAVAGESSTATWTVVWTDLLTACDLYRAKAYKVDKVPNSDDQFFAWISYDIDLFEEGSIANLTASIIGNVFGFKAVQALRLEDMRIPVAYLKTFQGPATGVIVERERMDKFGRPFLGATVKPKLGLSGKNYGRVVYEGLKGGLDFLKDDENINSQPFMRWKERFLYSMEGVNRSIAGTGEIKGHYMNVTAATMEDMYERAEFAKQLGTVIIMIDLVIGYTAIQTMGIWARKNDMILHLHRAGNSTYSRQKNHGMNFRVICKWMRMAGVDHIHAGTVVGKLEGDPLMIQGFYNTLLMSHLDEDLPKGIFFEQDWASLRKVTPVASGGIHCGQMHQLLDYLGVDVVLQFGGGTIGHPDGIQAGATANRVALEAIVIARNEGRDYVTEGPQILRDAAKTCGPLQTALDLWKDISFNYTSTDTADFVETPTAN

SEQ ID NO: 21981 - protein, 439 aa, Desulfovibrio vulgaris subsp. vulgaris (strain Hildenborough)
MALFTKEEALRYHACGHPGKVETVPVKPCATQRHLSMAYTPGVADACRAIHADAAEGYAYTNKGNLVAVVSNGTAVLGLGDIGPLAGKPVMEGKGVLFKVFADVDVYDLCIEQKDPAKIIEFVRMLEPTFGGINLEDIKAPECFEIEQTLIREMDIPVFHDDQHGTAIISGAGLIAALELAGKKAEEVKVVVSGAGAGAIACTNFFMALGVRRENVYMFDSRGLLHKGRAGLNAAKLAFAQERDHGSLADVMRGADVFLGLSVGGMVTPDMVASMAANPIVFACANPDPEIAYPDAKAVRDDLIMATGRSDYPNQINNVLGFPFIFRGALDVQARTINEEMKMAAARALAALAKEPVPAEALAPYGLASASFGVDYIIPKALDPRVIEWVAPAVAEAAMRTGVARRVIDLDAYRVELRERMKAARARIGAFIDSYGLDF

SEQ ID NO: 21982 - protein, 440 aa, Triticum aestivum
PREHWPVQDEHGADTKLPSQDTLSVDIKPNVVNKAAGEVPLGQADKISSTVSPVESSQTTAEVQKDPLGADVGEQKSLAETYLLQEEHDIPKDVSAKETKSDGIVGGVKASDDGKIMLDIIDAIHAAEKKQADTDAYTYSEEKRKLKERYEKELKDTSARELMYAEEAAILDKELKKEKMKAAAAVKELQEKTEQKLMDELQRKDEEASQQVEKVQELAKAELAAALAKEKASQIEQIAEADLNIDALCMAFYARSEEARQSHSVHKLALGTLALEEALSSGSPIRTEVDQLRKSLEGIDKDSLLELALSSLPEDVLKYGSDTRMELKQKFNSLKATIRHFGLIPSGGGGILTHAVAHVASNIKVEEDPSGDGVESLISRVEDLIVGGDLTAATEALTGGLQGTAAEEAAAEWVKQARKRAIAEQTLTLLHSYASSITFT

SEQ ID NO: 21983 - protein, 346 aa, Zea mays
MSSSLYKQLGLSGAGSPLSGRHLALLVLGAGFLALTVFVVHPNEFRIQSFFSGSSCGGRTVTDAAAAAVASPHGDTTTEKEDDARADDVRVLIGIQTLPSKRARRHLLRDVYSLQAREHPPVAGSVDVRFVFCNVTSPDDAVLVAVEALRYGDIIVLDCAENMDNGKTYTFFSTVARAFNGSGRRPRYDYVMKADDDTYLRLPALVESLRGAAREDAYYGLQMPCDTENFYPFPPFMSGMGYALSWDLVQWVASSDLARREQNGPEDMWTGRWLNLAGKGKNRYDNAPRMYNYKGASPDSCFRHGFVPDTIAVHMLKDDARWAETLAYFNATSGLYRQPLPAASSP

SEQ ID NO: 21984 - protein, 534 aa, GIBBERELLA ZEAE PH-1
MSSHKDEVKDETTVATPHDEELGSTDGEGQLKRHLQNRHMQMIAIGGAIGAGLFVGSGSALHKGGPAALVIGYLIIGIMLLCTNLALAEMAVLYPVNGAFYTYIVRFVDPSWGFACGWEYALSWLTVLPFELIAASKTIEFWRSDIHMAVWVTVFLVALTIVQIFGVRGYGEVEFVLSAIKIAACLGFIILGIIINCGGVGDQGYLGTKYWHDPGAFTDFKGFCAVFVVAAFAFGGTEMVGLAAAETADPRKSVPTASKQVFWRIALFYVINLFIVGTILRSDDDRLQGASGANTKASPFVLAIQDAGIKVLPSIFNAVITISVLSVANTCTFGSTRTMQAMAMRGHAPKFLNYIDGKGRPIYCVIIQLGFGLLAYIGESPKGGTIFDWLLALSGLAFLFVWGTICLAHARMRSGMKAQGVNMNLIPYKTPFGVWGSYLGVFLNVLALVATFYSALFAPDGSAPNAESFFMSFLAGPIILVLYLGYKVYSRDWKLYVRAIDMDLQTGISLLDEEIPEEPKTWASLPRRILSAVI

SEQ ID NO: 21985 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALASTVGGIGIAPGQTLGDECALFEATHGTAPKYAGQDKVNPGSIILSAKMMLRHMGWTETADLIVKGMEGAINAKTVTYDFERLMEGAKLL

SEQ ID NO: 21986 - protein, 333 aa, Archaeoglobus fulgidus DSM 4304
MDLFIVVAGIVGFYVAWNIGANDAANSMATSYGSRALTLKQIIIIASVLEFTGAVFFGKKVTHTIAKGIVPIELLDHNLVVYGALAALLSAGFWITISTYYHLPISTTHSIVGAMVGFGLAAVSQNHLTLDQIKWDVLARIALSWVISPLFGAALAFVVFSLIRVLLLDRFASESIEHVFRYLQVLTACYMAFAHGSNDVANATGPIAAIMGYSGGVPFWVLFFGGLGIAVGIATWGYRVIETVGKQITELTYTRGFSAEFATATTVLLASNFGMPVSTTHTLVGSVIGVGLAGGLASVNLKIVQKIIFSWIVTVPVAAAMTISLYTMMVVFV

SEQ ID NO: 21987 - protein, 1081 aa, Oryza sativa (japonica cultivar-group)
MVDTRRSAAAKRRASSEEAASPATDGAAAGAGAAGSSTPRRRSGKRAKAEATVGTPAAKAGGADATAAAAIDVIDSSVENLHGVARPTGAVPASSTVSNSGVKKKRTKYINVPSAEELSLWKARQAVANGRAEAWGRLISQSSESPSVPIYTTHFTVGHGGNYDLRLTESFPGSLICKLKHVKRGAALEIYVSKAVHVNGKVLDKTAKVTLVGGDEVIFSSLGRHAYIFQQLPEERSSTSTFSATCAFQQGQYPVTKGTLDVSSKGAKLSVMPFNFGNGRPPLVPHDTEIVSSLCKTMEEQSQLASEENLQVAQHQLLKEDLKKVVVNASDISDSFDSFPYYLSENTKNALLSSAYVNLCCKESIKWTKHISSLCQRVLLSGPAGSEIYQESLVKALTKHFGAKLLIIDPSLLASGQSSKSKESESYKKGDRVRYIGSVQSTGIILEGQRAPDYGSQGEVRLPFEENESSKVGVRFDKKIPGGIDLGGNCEVDRGFFCPVDSLCLDGPGWEDRAKHPFDVIYEFASEESQHGPLILFLKDVEKMCGNSYSYHGLKNKIESFPAGVFIVGSQIHTDSRKDKSNSGSPFLSKFPYSQAILDLTFQDSFGRVNDKNKEALKIAKHLTKLFPNKVTIQTPQDELELSQWKQLLDRDVEILKAKANTSKIQSFLTRNGLECADIETSACVKDRILTNECVDKVVGYALSHQFKHSTIPTRENDGLLALSGESLKHGVELLDSMQSDPKKKSTKKSLKDVTTENEFEKRLLGDVIPPDEIGVTFEDIGALENVKETLKELVMLPLQRPELFSKGQLMKPCKGILLFGPPGTGKTMLAKAVATEAGANFINISMSSIASKWFGEGEKYVKAVFSLASKIAPSVIFVDEVDGMLGRRENPGEHEAMRKMKNEFMVNWDGLRTKDKERVLVLAATNRPFDLDEAVVRRLPRRLMVNLPDASNRKKILSVILAKEDLADDVDLEALANLTDGYSGSDMKNLCVTAAHCPIREILEREKKERASAEAENKPLPPPRSSSDVRSLRMNDFKHAHEQVCASITSDSRNMTELIQWNDLYGEGGSRKKTSLSYFM

SEQ ID NO: 21988 - protein, 60 aa, Oryza sativa
  unsure (1)..(60): unsure at all Xaa locations
FGTRFRPSSSFDTKTTXTNAGAPVWNDNQALTVGPXGPILLQXYHLIEKVAHFXRERXPE

SEQ ID NO: 21989 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCVFPEDKTDLSIWPKTPSDYIDATREYAKQLRALTTTVLAVLSQGLGLEEGRLEKEVGGMEELLLQMKINYYPKCPEPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 21990 - protein, 272 aa, Brucella melitensis 16M
METGFWIKTRASKHLERFQRFRFNRNRSRIFAVPVIRASHAAKETIAMRPIAIAPSILSADFARLGEEVDAVLEAGADWVHIDVMDGHFVPNITFGPQVVKAIRPRTKAFFDAHLMIAPCDPYLEPFAEAGCDLITVHAEAGPHTHRSLQSIRALGKKAGLALNPATPAEALTNVLDDLDLILVMTVNPGFGGQKFIAPMLDKIRRVREMVGDRPIDIEVDGGITPETAGSVVAAGANILVAGSAVYKGNSVESYRANIDAIRAAAEAARNR

SEQ ID NO: 21991 - protein, 192 aa, Pyrobaculum aerophilum str. IM2
MDLTLIVDNYDSFVYNIAHYVAEAGSRPIVLRNDEVSVKLVERIRPDRIIISPGPGHPENPRDVGASPDIIREFTGRVPILGVCLGHQIIGVVFGARVRKARTIKHGKTSEVRHMGGVLYAGVPEVFRAMRYHSLVIDDLPEVLKVEAVSLDDGEIMGVRHVEHSTFGVQFHPESVGTPYGLRIIKNFIDLA

SEQ ID NO: 21992 - protein, 334 aa, Phytophthora infestans
MAASPNKKLREASQLDQLKQFTTVVADTGDFEQINKYKPQDATTNPSLLFKAAQMEQYSALVDDAVSYGKGLSADLSEKERLGYVIDKLSVNFGLEILKVVPGYVSTEVDARLSFDTESTIARAHRIIDLYEKAGIKKDRILIKIASTWEGIQACKHLQKEGISCNMTLLFGFAQAVGCAEAGATLISPFVGRILDWHKAKTGKSSYESHEDPGVVSVTKIYQYYKKYDYKTIVMGASFRNTGEITELAGCDRLTISPALLEELTKSTATLAKKLDAETAGKAYTGEKLSYDEKDFRLSMNEDAMATEKLAEGIRGFSADIVKLEQILKTKLGA

SEQ ID NO: 21993 - protein, 787 aa, Zea mays
  unsure (1)..(787): unsure at all Xaa locations
MQPDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKSWDNIREAKEAYASSGRQQEQANRQDQLSSQFASKAQVGPTPALIKAEVPWSARRXGNLSEKERVLKTVKGILNKLTPEKFDLLKGQLMEAGITTADILKDVISLIFEKAAFEPTFCPMYAQLCSDLNEKLPTFPSEEPGGKEITFKRVILNNCQEAFEGASNLRAEISKLTGPDQXXXXXXXXXXVKLRTLGNIRLIGELLKXXXVPEKIVHHIVMELLGSGTDXXPCPEEEDVEAICHFFNTIGKQLDENTKSRRINDTYFIQMKELTMNPQLAPRLRFMVRDVIDLRSNNWVPRREEIKAKTISEIHSEAEKNLGLRPGAASVIRNGRSSPGGPLSPGXXFPMNRPGTGGMMPGMPGSRKMPGMPGLDNDNWEVPRSKSMPRGDSIRNQGLLLNKPSTVHKTSSINTRLLPQGSGAALIGKSALLGTGVSASRPLSFTPGPTPAQTTPKAIRAAPAVVPAPDKQASALKGNTAELQKKTIALLEEYFGIRILDEAHQCIVELQSPDYYPEIVKEAVNLALDKGTNFVDPLVRLLEHLYTKKIFKTQDLESGCLLYGTLLDDIGIDLPKAPAQFGEIIARLTLLGALRFEALEVILKKMEDTYNRKAVSNAFMKTLEANPSGQAILGSPAAAAVIDACNSLLE

SEQ ID NO: 21994 - protein, 349 aa, Thermoanaerobacter tengcongensis
MKALLLAGGLGTRLRPLTDDLPKPMVPIMGKPLLERIILNLKKSGVDEVVISTHYKSDYIENYFKGKSKELGVKIHYVTEETPLGTGGAIKNAEKFFDDTFLILNSDIVSDIDYADLVKYHKRRRAQVTIASIEVRDTSQYGVIEFDSKGFITAFKEKPKPGESNSKYINAGVYVFEPEVLKEIPANTQVSVERETYPLLLSKGYKMAIYKFTGYWMDIGTVDKYKKVHEDILKGKSRFVAGLSTRGIILGENVKIHPTASVIGPAYIGDNTEVDAYATVGPYTVIGSNCRIGQESKVSNSVLWDNIKVRRFARLENSVVTSECVVEVNMEIKNTVFTANKLADITLTP

SEQ ID NO: 21995 - protein, 398 aa, Oryza sativa (japonica cultivar-group)
MARTMTMRVSSLLVAVLLLAALSFQACSGHGGINDGDGQVDAPATPASSSGVWSKGLIAVKVWCLVILLVFTFAGGVSPLLLPFAAGVFLGTALMHFLADSTSTFKGLTTNQYPFSFMLTCVGFLLTMLSDLVIAAVARRSAAAGVSDNQVSEQQQRQQAEGAVMSRKEEEAAAVAHPAMLVQIAFEILQETRFEPRNIANPPVDLLSSKQMGTAPIVAIQSSAQLRTTEAEIDETTACRHRRSRTPCCSSSRSVSTPSLKGSPLVSQASKSEAWRNLWTIGLHKIFAAVAMGIALLRMIPKRPFLMTVVYSLAFAVSSPVGVGIGIAIDATSQGRAADWTYAISMGLATGVFIYVAINHLIAKGYRPHHPTAADKPLFKFLAVLLGVAVMAVVMIWD

SEQ ID NO: 21996 - protein, 762 aa, Neurospora crassa
MSSSSVVDHSPHDSAPSPLVPTASNLILIDNYDSFTWNVYQYLVLEGAKVTVFRNDQITIDELIAKNPTQLVISPGPGHPGTDSGISRDAIRHFAGKIPIFGVCMGQQCIFDVYGGDVCFAGEILHGKTSPLRHDGKGAYAGLSQDLPVTRYHSLAGTHVTLPECLEVTSWIAKEDGSKGVIMGVRHKEYTIEGVQFHPESILSAEGRGMFRNFLHMQGGTWAENERLQKAAQAQAANTKSDAPTPKKSNILQKIYAHRKAAVDAQKQIPSLRPSDLQAAYNLSIAPPQISLVDRLRNSPFDVALCAEIKRASPSKGVFALDIDAPSQARKYALAGGSVISVLTEPEWFKGSIDDLRAVRQVLNGMPNRPAVLRKEFIFDEYQILEARLAGADTVLLIVKMLEYELLERLYKYSLSLGMEPLVEVQNTEEMATAIKLGAKVIGVNNRNLESFEVDLGTTGRLRSMVPSDTFLCALSGINTHQDVLDCKRDGVNGILVGEAIMRAPDATQFVRELCAGLTGPVSKSAAEPLLVKICGTRSAEAAAEAIKAGADLVGMIMVPGTKRCVDHETALSISQAVHMSKKTGSTEVSSQASKSARDFFNINAEIIRKRGPLLVGVFMNQPLEEVLEKQHLYDLDIVQLHGDEPLEWANLIPVPVVRKFKPGQVGLATRGYHAVPLLDSGAGSGTLLDLESVKKELEKDEQVTVLLAGGLEPSNVVETVKSLGPLSERVIGVDVSSGVEEGGKQSLEKIREFVKAAKSVR

SEQ ID NO: 21997 - protein, 488 aa, Vaucheria frigida
MSKSVQERTRIKSQRYESGVIPYAKMGYWDAFYNVKHTDILALFRITPQPGVDPVEAAAAVAGESSTATWTVVWTDLLTACDIYRAKAYRVDPVPGTTDQYFAYISYQCELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAAATGEIKGSYLNATAGTMEEMYERADYAKQIGSIIVMIDLVIGYTAIQSMSIWARKADMILHLHRAGNSTYARQKNHGINFRVICKWMRMAGVDHIHAGTVVGKLEGDPLMVKGFYNTLLETKLDINLPQGLFFEMEWAALRKTVPVASGGIHCGQMHQLLYYLGDDVVLQFGGGTIGHPDGIQAGATANRVALESMVLARNEGRDYLNEGPQILRDAAKTCGPLKTALDLWKDITFDYTSTDTPDFVEIATKSK

SEQ ID NO: 21998 - protein, 314 aa, Sinorhizobium saheli
VMFDGSSIAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFP

SEQ ID NO: 21999 - protein, 446 aa, ASPERGILLUS NIDULANS FGSC A4
MKVTLKEWNAVATWRWDMPEDEVCGICRVQFDGTCPTCKFPGDDCSLLLGKCGHSFHMWLSLPLNRQPHYDRDHVASSSAMSLPKPSISPSISSSPSNQSLRRPLSRPHSIDQAAHPQTQPQSIDHYEQASLNTGATVDSHLAEHNDQIYHETAPSFASQMLSQPFFTLIEDTHTSEYYHPTVHYIFSDDDTDIVTEAALRSLESEQDALPNPSIKGKSKAVHRHPSRVGEHESETPYEDDNPARKESLLPDPIPGVRDNYIILDIDHVPSRQENEYPAGMSPGTHPQDQPQGPTPDIANPLITEQQLPPQGQFRITSAHSLSPSWQILNTQLLPAPTFENSSKKPLNGGLMLQIQGTSGLPFGILDRDKEASGQRLEDMMDQFARRMEELRMVIENGERGMAVGREGPVQETSLLGEPSARDIADVAPVVESEEVQKTEAVPGDQ

SEQ ID NO: 22000 - protein, 422 aa, Staphylococcus aureus subsp. aureus MW2
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVEKEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 22001 - protein, 787 aa, Triticum aestivum; identical to SEQ ID NO: 20849

SEQ ID NO: 22002 - protein, 122 aa, Triticum aestivum
GYPGGAVLYIYDAIFKQDKFQHILVRHEQAAVHAADAYSRCSNEVGVCLVTSGPGVTNAVTGLSTAYMDSIPMVVISGQVPTAAIGQDAFQECDTVGITRPVVKHNFLVKDEKNKKKTKIKG

SEQ ID NO: 22003 - protein, 357 aa, Pisum sativum
MAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDESLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 22004 - protein, 103 aa, Salmonella enterica
FGDNGSGMHCHMSLAKNGTNLFSGDKYAGLSEQALYYIGGVIKHAKAINALANPTTNSYKRLVPGYEAPVMLAYSARNRSCLHPYSGGGVSESAPYRSSLPGP

SEQ ID NO: 22005 - protein, 305 aa, Pichia jadinii
MATEKKQSTFLIDFLMGGVSAAISKTAAAPIERVKLLIQNQDEMIKQGRLAKRYDGIADCFRRTAGEEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 22006 - protein, 238 aa, Cicer arietinum
FDKGARTALAFVTLRADGEREFMFYRNPSADMLLTPEDLNLELIRSAKVFHYGSISLIVEPCRSAHLKAMEVAKDAGCLLSYDPNLRLPLWPSPEEARNQILSIWDKADLIKVSDVELEFLTGSDKIDDASALSLWHPNLKLLLVTLGENGSRYYTKNFHGSVDAFHVNTVDTTGAGDSFVGALLGKIVDDQSILEDEARLREVLKFANACGAITTTKKGAIPALPTEADVLSLIKGE

SEQ ID NO: 22007 - protein, 486 aa, Mycobacterium vanbaalenii
MISANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFLKLAPALVAGNTVVLKPAANSPLVLAEIIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTAADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 22008 - protein, 705 aa, Oryza sativa
MASRMALRPNDVTLRLTPPLAAAARRNRRAAAGGVRVYAVASGAVSTKVENKKPFAPPREVHVQVTHSMPPQKIEIFKSLDDWARDNILSHLKPVEKCWQPQDFLPDPASDGFHDEVKELRERAKEIPDDYFVCLVGDMITEEALPTYQTMLNTLDGVRDETGASPTAWAVWTRAWTAEENRHGDLLNKYLYLTGRVDMRQIEKTIQYLIGSGMDPRTENNPYLGFIYTSFQERATFISHGNTARHAKDFGDLKLAQICGIIASDEKRHETAYTKIVEKLFEIDPDGTVLAFADMMKKKISMPAHLMFDGEDDKLFEHFSMVAQRLGVYTAKDYADILEFLVSRWKISDLTGLSSEGNKAQDYLCTLAARIRRLDERAQSRAKKADQISSPEPEKKKKMIGWGDVYKVVAATVPLYFALFLGYGSVRWWRIFTREQCDAVNRLVAFFALPFFTFEFTLHTDPFQVNYRAVAADVISKAVIVAVIGAWARFMSKGGCAVSWSITSFSLSTLTNSLVVGVPMARAMYGEWAQQLVVQLSVFQAIVWLTLLLFVLEVRKAAIGMYVDGAEAAAAAGKDVEAAGAAAAAGTVVVAAAAGKPSLWALVKVVAHKLARNPNTYASFVGITWACLANRLHIALPSAFEGSVLIMSKSGTGMAMFSMGLFMAQQEKIIACGTSFAALGLVLKFALGPAAMAIGSIAVGLRGDG

SEQ ID NO: 22009 - protein, 355 aa, Thermoanaerobacter tengcongensis
MYRIAVLPGDGIGPEVIEEGLKVLKAVEEKYGLRFDIKKYPFGGEAIDKYGEPYPEETRNGCLSSDAVLLGAVGGPKWDGLEGDKRPEAGLLALRKSLGVYANLRPAVLYPSLKDASPLKNELLEKGLDILVVRELTGGIYFGPRGKEAIGYGFRAYDTEVYETQEIERIAVIAFEAALRRRKKITSVDKANVLESSRLWRKTVEEVAKRYPEVELNHMYVDNCAMQLVKNPFQFDVILTNNMFGDILSDEAAQIVGSIGILPSASLRGDRVGLYEPIHGSAPDIAGKKIANPLATILSVAMMLQYSFGEEEAAQDIRKAVERALEEGFRTADLGKGIVLSTEEMGDKVVEYIKG

SEQ ID NO: 22010 - protein, 273 aa, Pavlova lutheri
THGRFPGTVECDEANNILIVNGKKIKFYAAKSPNEVPWGEAGAHIVCESTGIFTVIDKASAHLQGGAKKVIISAPSADAPMFVMGVNHTSYTKDVNILSNASCTTNCLAPLAKIIHEEFGIVEGLMTTVHATTATQKTVDGPSGKDWRGGRGAGQNIIPSSTGAAKAVGKVLPALNGKLTGMAFRVPTPDVSVVDLTCRLSKQTTYDEIKKVIKAKCETPEYKGIMGYTEDEVVSQDFVHDSRSSIFDAGAGIMLTGDFVKLVSWYDNEWGYS

SEQ ID NO: 22011 - protein, 146 aa, Lactobacillus delbrueckii subsp. lactis
  unsure (1)..(146): unsure at all Xaa locations
MTKVVIENVHAREIFDSRGNPTVEVEVTLSNGVVGRAXVPSGASTGENEAVELRDGGSRLGGKGVMKAVNNVNTAINNELQGADPFNQPAIDKAMIELDGTPNKGKLGANAILGTSMATAVXAAKATHQPLYRXLGGTDLSMPQTF

SEQ ID NO: 22012 - protein, 453 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNNNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQPLIMNDQQQPVMSEQQQQQQQQQQQQ

SEQ ID NO: 22013 - protein, 302 aa, Zea mays
MAGMSLQHPWAFAFGLLGNVISFMTFLAPIPTFYRIYKSKSTEGFQSVPYVVALFSAMLWIFYALIKSNETFLITINAAGCVIETIYVVMYFVYAPKKAKLFTAKIMVLLNGGVFGVILLLTLLLFKGSKRVVLLGWICVGFSVSVFVAPLSIMRRVIQTKSVEYMPFSLSLSLTLSAVVWFLYGLLIKDKYVALPNVLGFIFGVVQMVLYVFYMNKTPVAATAVGKDAGKLPSAADEHVLVNIAKLNPALPERTSGMHPVTQMAAVPARSCAAEAIAPAMLPNRDVVDVFVSRHSPAVHVV

SEQ ID NO: 22014 - protein, 355 aa, Oryza sativa (japonica cultivar-group)
MDQSFGNLGGGGGAGGSGKAAASSFLQLPLSTAAAATAYYGTPLALHQAAAAAGPSQYHGHGHPHHGGGHHHSKHGGAGGGEISAAEAESIKAKIMAHPQYSALLAAYLDCQKVGAPPEVLERLTATAAKLDARPPGRHDARDPELDQFMEAYCNMLAKYREELTRPIDEAMEFLKRVESQLDTIAGGAHGGGAGSARLLLADGKSECVGSSEDDMDPSGRENEPPEIDPRAEDKELKFQLLKKYSGYLSSLRQEFSKKKKKGKLPKEARQKLLHWWELHYKWPYPSETEKIALAESTGLDQKQINNWFINQRKRHWKPSEDMPFVMMEGFPPQNAAALYMDGPFMADGMYRLGS

SEQ ID NO: 22015 - protein, 269 aa, Microbulbifer degradans 2-40
MTSSFGKLAAGFKNLLGSNKSAAPASDNKKAVEVVSEETLKAHALPFSIPLEYGVGTKVNDTPSVTICEDFLTQAEVFQIIKAAGDKMQRARVSSGKEGIESAGRTGSNCWVAHDHNKVTHALAKRISKLVGISLQNAESFQVIHYGVSQEYSSHFDAWEFNTERGERCMARGGQRLVTCLIYLNDVPAGGGTGFPELDLEVQAKKGRMVIFHNCYPGTNYRHPHSLHGGLPVEEGEKWAVNLWFREADYWAGTKKAAAPARKKYGKVM

SEQ ID NO: 22016 - protein, 506 aa, Candida tropicalis
MSLTETTATFIYNYWYIIFHLYFYTTSKIIKYHHTTYLMIKFKASPPLNYINKGFFGIQATFTELKHLICHTSIDYAIDQFNNVPFPHVHTFVTKVLGNELIMTKDPENIKVLLRFPVFDKFDYGTRSSAVQPSLGMGIFTLEGENWKATRSVLRNMFDRKSIDKVHDFEPHFKTLQKRIDGKVGYFDIQQEFLKLGLELSIEFIFGQVVSEDVPHYDDFTQAWDRCQDYMMLRLLLGDFYWMANDWRYKQSNQIVQAFCDYLVQKSLENTCNDKFVFVHQLAKHTTNKTFIRDQALSLIMASRDTTAELMAFTILELSRKSHHLGKLREEIDANFGLESPDLLTFDSLRKFKYVQAILNETLRMYPGVPRNMKTAKCTTTLPKGGGPDGQDPILVKKGQSVGFISIATHLDPVLNFGSDAHVFRPDRWFDSSMKNLGCKYLPFNAGPRTCLGQQYTLIEASYLLVRLAQTYETVESHPDSVYPPRKKALINMCAADGVDVKFHRL

SEQ ID NO: 22017 - protein, 597 aa, GIBBERELLA ZEAE PH-1
MAALDQHRGYVQDHYQEVKQERSPEYVDENNAAGYQIVREPLWNKGLAFTPEQRANKNLTGLIPHTIESFDTQCARAMKMIQTRQTPIDKYLYLSTLKDQNTDLFYRLLIDNVRELMPLVYTPTIGDVCLQYSSIYTRPEALYISIKQRKSIRAMLRNWPCQDPEICVVTDGSRILGLGDLGINGVGISIGKLALYTGAAGIHPSKTLPIVLDCGTNNEENLQDPFYLGLRQKRPSYPEQQAFMDEFMEATREVFPNMVVQFEDFDSEKAFGYLDRYRDQYRCFNDDIQGTGAVVLGGYIGAVEQSNVPIEEQRLVFMGAGSAGVGVAKQLVEYYTRRGLSEAAAREKFWLVDTKGLVTKDRGDRLAEHKKYFARTDNNGQQFRTLEEVIEYVKPSALVGLTATFGVFTEPVVRALKSSVQEGGLERRPILFPLSNPLTKAECTFEQAIEWTEGTVLFASGSPFNPVKAKFGDETHHTVYHPNQGNNVYIFPGLGLGAILAKASRVTDEMVYTSAAALAGSLNADEVHKGLIYPRIERVRDASVIVAREVMKAARRGGVSELPESQWAEWEEWGDVALTSFIKQHIYNPLCFADAKL

SEQ ID NO: 22018 - protein, 119 aa, Musa acuminata
ESLKKTLKETRKDIPIKPKQAPLGKPLKSSGVLLDEKAEFEEVEPEEEDSEGEEPSFWKSNPKLPKMIRMANLCVVGGHGVNGVAEIHSEIVKQDVFNSFYKLWPEKFQNKTNGVTPRR

SEQ ID NO: 22019 - protein, 161 aa, Zea mays; identical to SEQ ID NO: 17296

SEQ ID NO: 22020 - protein, 346 aa, Triticum aestivum
MRCAVVLLLVFAAARAAAVVTDGLLPNGNFESGPAKSELVNGTVVKGGKAIPKWETSGFVEYIESGHKQGDMLLVVPQGAYAVRLGNDASILQRIPVARGSYYAITFSAARTCAQAERLNVSVSPESGVLPMQTIYGSNGWDSYAWAFKAKLDVVELVIHNPGVEEDPACGPLIDAVAIRTLYPPTLSKGNMLKNGGFEEGPYFLPNASGGVLVPPNIEDDHSPLPAWMIMSSKAVKYVDAAHFKVPEGARAVELVGGKESALVQEVRTVPGWAYRLSFAVGDSADGCKGSMVAVLDFVAVRDRTRVVFQSAFYHMKADGTLCGPVIDDAKLVGLRKKPAARRLML

SEQ ID NO: 22021 - protein, 585 aa, Aquifex aeolicus VF5
MPAKKGADIVIETLKAEGVEVVFGLPGGAIMEVYDALYRLGGIKHILARHEQGAGHMAEGYAKATGKVGVVMVTSGPGATNLVTPIADAYMDSVPLVAITGQVPTHLIGNDAFQEVDIVGITRPITKHNFLVKSIEELPLILREAFYIARTGRPGPVLVDLPKDVTQQIADVKIPSDEEVKAALPGYKPHVEGNPQQIKKAAELIMSAKRPVLYVGGGAVNSEAQEELIELAELMQIPVTTTTQGKGAFPETHPLSLRMLGMHGTYYANMAVYNSDLLIAVGARFDDRVTGKIDEFAPGAKIIHIDIDPASISKNITVDVPIVGDVKIVLRKLINEIKKRGAKILYPEERKKWLEQIEKWKKLHPLTYRNSDKVIKPQYVIEQLWEATNGEAIIVPGVGQHQMWAAMFYKFKYPRQFINSGGLGTMGFGLPAGIGAKIGRPDREVWVVDGDGSFVMTMQEVITAVQYKVPVKVAIINNAYLGMVRQWQELFYDKRYSEVDLSVQPDFVKLAEAMGAVGMRAKKPKEVREVIEEARKIDDRPVIIDFWVDREENVLPMVPAGKSYKDMILEDGKGKHEAETMYLVG

SEQ ID NO: 22022 - protein, 492 aa, Zea mays
  unsure (1)..(492): unsure at all Xaa locations
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMFTFLFDDVGIPLNYRHMEGFGVNTYTLINRDGKPHLVKFHWKPTCGVKCLLDNEAVTVGGTCHSHATKDLYDSIAAGNYPEWKLYIQTIDLDHEDKFDFDPLDVTKTWPEDIIPLQPVGRMVLNKNVDNFFAENEQIAFCPAIIVPGIHYSDDKLLQTRIFSYADTQRHRLGPNYLMLPVNAPKCAXHNNHHDGFMNFMHRDEEVNYFPSRFDPARHAEKVPIPPRVLTGCREKCIIQKENNFKQAGERYRSFDPARQDRFIQRWVDALTDPRVTHEHRTIWISYWSQCDAALGQKLASRLNLKPSM

SEQ ID NO: 22023 - protein, 360 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVAARWYRAPEIMLTFKEYTKAIDVWSVGCILAEMLSGKPLFPGKDLTFPDHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 22024 - protein, 386 aa, Bifidobacterium longum NCC2705
MSSIPANLPLRNDLIGEEPYGAPQLDVPVCLNVNENPYAPDPAVCDTIAKRVREIAPTLNRYPDREHIELRQAFSDYLARESGTRLDVDELWGANGSNEIMLQLFQAFGGPGRTALGADPTYSMYPEYARDTFTGWKLAHRNADFTLNVDKVLEAIAEVKPSMVLLTSPNNPTGTPLPMEDIERILAACETAEVVGAGEGVHPILVIDEAYVEFRKPGTPSAVSLIKDHPNLAVSRTMSKAFAFAGARVGYLAASKGIIDCVRIVRMPYHLSAVTQAAALAAFEHADEQLSRVEHLRETREATAAWLKEQTYKDQPLEVAESGSNFLLFGGHFDKREAIFDELLKRGVLIRVVGPDGWLRVCMGTDEEMETFRNALVEVLRIVEAA

SEQ ID NO: 22025 - protein, 447 aa, Streptococcus pyogenes M1 GAS
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFESLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 22026 - protein, 550 aa, Emericella nidulans
MSPPSAKSMEEGRTPSVQYGYGDPKTLEGEIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLASEVTASGLIIEYWNPPVSVGLWIAIVLVVILALNVFAVEWYGESEFWFAGLKILAIIGLIILGVVLFFGGGPNHDRLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIQNAGIGGLNHVVNAAILISAWSSGNAWCYAGSRTLYSLAGEGQAPKIFTRTNRTGVPYVAVLATWTIGLLSFLNLSSSGQTVFYWFTNITTVGGFINWVLIGIAYLRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 22027 - protein, 502 aa, Zea mays
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 22028 - protein, 316 aa, Zea mays; identical to SEQ ID NO: 9688

SEQ ID NO: 22029 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 22030 - protein, 267 aa, Zea mays
  unsure (1)..(267): unsure at all Xaa locations
MGALGDRLRAFSTNRWLVFVAAMWLQSMAGIGYLFGAISPVIKAALGYNQRQVAALGVAKDLGDCVGFLAGSLSAVLPSWAMLLIGSAQNFLGYGWLWLIVTRQAPALPLWMMCVLIYVGTNGETFFNTTALVTCIQNFPKSRGQTVGIMKGFAGLSSAILTQLYAVMHTPDHATLVFMVAVGPSLVALGLMFIIRPVGGHRQVRPSDKNSFLFIYTICLLLASYLVGVMLVQXFHALSDXVXGILTVLLLILSGXPIMIPVTLNYH

SEQ ID NO: 22031 - protein, 409 aa, Triticum aestivum
  unsure (1)..(409): unsure at all Xaa locations
KSEMLRRGQVEHVKAERNLLAEVDSAYIVKLYYSFQDDEFLYLIMEYLPGGDMMTLLMRKDXVTEDEAKFYIAETVLAIESIHKHNYIHRDIKPDNLLLDLSGHLKLSDFGLCKPLDSSNFPNLNEPDYTPGKGAKPLPDNTSRLTNSSAPKRTQQEQLSHWQKNRRMLAYSTVGTPDYIAPEVLLKKGYGMECDWWSLGAIMYEMLVGYPPFYSEDPMSTCRKIVNWRSHLKFPEEAKLSSETKDLISKLLCNVEQRLGTKGAHEIKAHTWFRGVQWEKLYQMKAAFIPEVNGELDTQNFEKFEETGAQVQSSSKAGPWRKMLPSKDANFVGYTYKNFEIVNDDEVAGIAELKKKSSKSKRPTIKTLFESMDEDEPVHGSFLNMLPHKEGQPSSHSSAPPEQYQPRRK

SEQ ID NO: 22032 - protein, 220 aa, Photobacterium profundum
MIAPSILSADFARLGEDVEKVLAAGADVVHFDVMDNHYVPNLTFGAPICKALRDYGITAPIDVHLMVKPVDRIIPDFAKAGATMITFHAEATEHLDRTLQLIKECGCQAGVVFNPATPLHHLDYVMDKVDMILLMSVNPGFGGQSFIPNTLDKLREVRQRIDASGYDIRLEIDGGVKADNIREIAEAGADMFVAGSAIFNQPDYKAAIDEMRAELAKVER

SEQ ID NO: 22033 - protein, 318 aa, Zea mays
MQTPLCANAPAEKGGKNFMIDFMMGGVSAAVSKTAAAPIERVKLLIQNQDEMIKSGRLSEPYKGIVDCFKRTIKDEGFSSLWRGYTANVIRYFPTQALNFAFKDYFKRLFNFKKDRDGYWKWFAGNLASGGAAGASSLFFVYSLDYARTRLANDAKAAKGGGERQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 22034 - protein, 342 aa, Streptomyces coelicolor A3(2)
MTTAQTAPPPPMRLRELVFGAACAAALRAAARLGVADALGDTPMAVEDLAAAVKTEPKPLRRLLRALTCYGVFTEQRNGTFAHTDMSRLLREDDPHSLRNITLWCTEPWTWDAWPLLDEAVRTGSNVVEGLYGKEFFTYLNEDAPQSAEVFNRAMTTSSRQSAQDVAALLDLSASTSVADIGGGQGHVVASLLEKYPAMRGTLLDLPRVVENADPRLREGGALADRVRIVPGDCREAIPVRADVYVIKNILEWDDDSTARALRNVMAAGGPGARVVVIENLVDDSPSMRFSTAMDLLLLLNVGGAKHTTDSMVGRLTDAGLVIDDIRPVNPYLHAFDCTVPK

SEQ ID NO: 22035 - protein, 476 aa, Mischococcus sphaerocephalus
SDRYESGVIPYAKMGYWDADYNVKHTDILALFRITPQPGVDPVEAAAAVAGESSTATWTVVWTDLLTACDIYRAKAYRVDPVPGTTDQFFAYIAYECELFEEGSLANLTASIIGNVFGFKAVKALRLEDMRIPFAYLKTFQGPATGLIVERERMDKFGRPLLGATVKPKLGLSGKNYGRVVYEGLRGGLDFLKDDENINSQPFMRWRERFLYCMEGVNRAAASTGEVKGSYLNSTAGTMEEMYARAEYAKEIGSIIIMIDLVIGYTAIQSMAIWSRANDMILHLHRAGNSTYARQKNHGINFRVICKWMRMAGVDHIHAGTVVGKLEGDPLMVKGFYNTLLDTKLTINLPQGLFFDMDWASLRKCVPVASGGIHCGQLHQLLYYLGDDVVMQFGGGTIGHPDGIQAGATANRVALEAMVLARNEGRDYLNEGPQILRDAAKMCGPLKTALDLWKDITFDYTSTDTPNFVETATEIK

SEQ ID NO: 22036 - protein, 103 aa, Desulfitobacterium hafniense
MQKIKLIATGGTIAMRKDSFGKTVPAVTGHDLLESIPELQESAFWNVEEFSNVASCNFNPERMLQLARRVEEAFADPDCMGIIITHGTDTLEETAYFLELKVK

SEQ ID NO: 22037 - protein, 704 aa, Rhodospirillum rubrum
MAKRSTDALTPAEIADAKILRGTGGETHQIAEGDTPVLTTQQGIPVADDQNSLRIGPRGPTLLEDFAFREKIFHFDHERIPERIVHARGFGAHGTFETYEDLSALTSADIFQRAGEKTPAFVRFSTVAGNLGSSDVARDVRGFAVKLYTKQGNWDIVGNNIPVFFIQDAIKFPDLIHAAKQEPDSGFPQAQTAHDNFWDFISLMPESLHMALWIMSDRTIPRSFRFMEGFGVHTFRLVTAEGKSSFVKFHWKPKLGLQSVVWNEAVKINGADPDFHRRDLWSAIKRGDYPEWDLGLQVFDDAFADSFPFDVLDATKLIPEELVPIRIVGRLVLDRTVDNFFAETEQVAFHTANIVPGIDFTNDPLLQGRNFSYLDTQIKRLGGPNFTHLPINAAKCPFHSFQQDGHMAFVNPKGRANYEPNSWGPGIGGPRESPESGFHSFPAEDGGEKRRVRGELFADHYSQARQFYRSQTPVEQTHIKDSFVFELSKVETPAIRARVVSHLLTIDQTLAQKVADGLGLAELPEAAKPARPLVEDLPASPALSILLNPPKDFSGRKVGVLVSDGVDGAFLDEIERLLTAEGAQMEVIAPRVGGFTAKDGTLRPAHQKVNGAPSVLYDAVAVLLSTEGAKLLLNEATAKDFVSDAFAHAKVIAFTQAAQPLLEKAGVIADEGCLLLDTPAKAETFLGLCRKGRRWEREAKVHAV

SEQ ID NO: 22038 - protein, 440 aa, Xanthomonas axonopodis pv. citri str. 306
MLATLVLFPVPALIAVNVLVALGFLATFGLKLLLVWFGSRHRIDIKVTEDEVAALRDDDLPVYTVLVPMYKEPEVLPILANALRKLDYPISKLDVKLVLEADDLDTIEAAKKLGLEAFFEIIRVPPSQPKTKPKACNYALHFARGELLTIYDAEDKPEPDQLKRVVAAFRKAEKDVVCIQARLNYYNADENWLTRMFTLEYTLWFDFYLPALEYLRIPIPLGGTSNHFRLDVLRQVRAWDPYNVTEDADLGVRLIQNGYRVNVVNSTTFEEANVSIPNWIRQRSRWLKGYMQTWLVHMRDPVHLYRSTGFKGFWGFQFFIGGGFFNALGVPVLWALYAAWALTGTSMFERFFPPWLAAVSLVNLLLANAFFIYITLVAAFKRDYFKLAPYALTVPFYWALQSIAAYKGLWQLIHNPFYWEKTTHGISKHSENERRAALEE

SEQ ID NO: 22039 - protein, 367 aa, Corynebacterium efficiens YS-314
MPESTMNRVTTSHDDPLCDPLRYHGDRAADGAVLDFAVNVQADAPPDWLREVVRSGVDTLGSYPGHELYRDATAAVAAHHGVTPEQVLLLNGAAEGFSLLARLRPAWPVIIHPGFTEPEACLVDAGIDVDRVVLRAPFDLDRAIDALGFGEVHEEADLVVIGNPTNPTGRLYGVDELSRLAEPWRYLVIDEAFLDVADHTHATSMISRIGQIPGLIVLRSLTKTWSLAGLRCGYLISDAETVTRLSRGRAHWPLGTLQLRAIQAVMEQGTPHLPTITADIARNRESMVTALETAGFTVHPSAAPYLLVQPPGGADRAERTRRALADRGIAVRRCDTFPGLDSGFWRLAVREPAQVAALLQAIADIGA

SEQ ID NO: 22040 - protein, 454 aa, Triticum aestivum
NSARGAKEDLRYPRSLLQNVIWTCLNKFVEPVLNCWPINKLRDTALKNLMKHIHYEDESTKYIGVCPINKALDMICCWIEDPNSDALKLHLPRIYDYLWLAEDGMKAQVYDGCQSWEPALIVQAYCSTDLVNELGPTLRKAHEFIKSSQVLENHPNSEAYYRHRSKGSWTLSTADNGWSVSDCTAEALKALLLLSKISPNLVGDPIKGERLHDAVDCLLSFMNKDGTFSTYECKRTTSLLEVLNPSESFLNIIVDYPSVECTSSVLQALIMFKELYPGYRKEEIGKCVKNASKFIEDKQRKDGSWFGTWGICFTYGTFFGVKGLIASGRTYENSSSIRKACNFLLSKQLSTGGWGESYLSSETEAYVEATSPHAVNTAWAMLALIYAGQVERDPTPLYHAAKELINMQLETGEFPQQEHVGCFNCSIYFNYGNYRNLYPIWALGEFRRRLLAKN

SEQ ID NO: 22041 - protein, 253 aa, Triticum aestivum
  unsure (1)..(253): unsure at all Xaa locations
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAXSPDVDGFLVGGASLKPEFIDIINAATVKSA

SEQ ID NO: 22042 - protein, 352 aa, Bifidobacterium longum NCC2705
MTVKIGINGFGRIGRLAFRRIFELQARGGQAGDIEVAAINDLTTPATLAYLLKYDSTHGTFRHDDGTPVDVKATEDSIIVDGKEYKVYAEKDANNIPWVKNDGVEYVLECTGFYTSAEKSQAHINAGAKKVLISAPAKDDTTPTVVFGVNHDILKASDVIVSAGSCTTNSMAAMVKLLDEKFGIKAGFMTTIHAYTGTQMLLDGPRGTKTGRNLRAAAINTIAHSTGAAKAIGKVVPSVNGKLQGHAQRVQVPDGSVTELTTVLNTETTADEINAAFKAAFSDTDYYGYNDEGIVSSDILGDTHGGVFDPTQTDVNTIDGVTLARTVSFYDNEYGFTSNMIRTLLYFAEISE

SEQ ID NO: 22043 - protein, 254 aa, Sinapis alba
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSSKELQNLEQQLDTALKHIRSRKNQLMHDSINELQRKEKAIQEQNSMLSKQIKEREKILRAQQEQWDQQNHGHNMPPPPPPQQIQHPYMLSHQPSPFLNMGGLYQEEDPMEMRRNDLDLSLEPVYNCNLGCFAA

SEQ ID NO: 22044 - protein, 80 aa, Glycine max
  unsure (1)..(80): unsure at all Xaa locations
CISLGGFAQRLLVQCEAVLSVDFFAPNTEVGVDNLFEMMDRMVAHNPSFFDITXGAGGTTADLTLGMAIYMHDIVCVEAI

SEQ ID NO: 22045 - protein, 470 aa, Oenococcus oeni MCW
MAYQTVSPYTNETIKKYDFSTQDDIERALSQGHTLYKKWRNGPLDKRVATLHTIAKLFREHEDELAKTAVNDMGKLLREAKGEVELCAMIADYFADHGPEMLKPTPLKTIATGDAEIVKHSTGVVFAVEPWNFPYYQIMRVFAPNFIVGNPMVLKGPSNTPGSSDAFGKIVQEAGAPEGSFTNLFLNYDQASALVADPRVQGVALTGSERGGRSIAKAAGENLKKNTMELGGTDAFIVLDDADIDQVADIAWRARLYNAGQVCTSSKRFIVADNLYDEFLTRLKEKFAAVKPGDPMDDSTTLAPMNSKRAKEKLQEQVDQAIKNGATLYYGNEPIYLDGQFFQPTILTDIRKDNPAYSEEMFGPVAQVYKVHSEQEAIDLANDANYGLGGIVFSGDPDRGAKVASQIETGMVFVNNFMSSLPELPFGGVKNSGYGREMSQLGIMAFVNEELIVKADKPDLSNPAGGLIFL

SEQ ID NO: 22046 - protein, 462 aa, Erwinia pyrifoliae
  unsure (1)..(462): unsure at all Xaa locations
MMKNVSSAVAVSRNPATGEVFARYPFATIAEVDSALALTNGAFQYWRHSAMSDRVQLLCNVADALRQQARELAEMMTSEMGKPVDQGLAEVEKSARLCEWYAGHGPAFLQREPTLVEGNKAFVDYLPLGPVLSVMPWNFPVWQVLRGAVPILLAGNSYLLKPAPNVMGCALLLQQILTRVGVPEGLFAVVNADNDGVAQAINDRRIAAVTVTGSVRAGAAIAALSGAAIKKCVLELGGSDAFIVLADADIDAAVKGAIAGRFMNNGQLCISAKRIIVEAPVFDAFRDKFVSAVKEMKIGDPRESGTWIGPMARYDLRDELDSQVQATLKEGATLLLGGHVLPGEGNYYAPTVLXDVKPGMTSFAQELFGPVASLIQADNAXHAVAMANDSEFGLGGSMWSRDLAVAQKLASRIETGGVFINSPSFSDPRVPIGGVKKSGFGRELSHFGLREFTNTQTVWMEE

SEQ ID NO: 22047 - protein, 344 aa, Schizosaccharomyces pombe
MHGILRVKLSEEQRKLKAEKERAKIEEYRGLVSRFQEARKRKDYSEGNLKLTTELLDWNPETYSVWNYRREILLNDVFPKISLNEKQDLLDNELKYVLSKMKVFPKVYWIFNHRRWCLENAPYPNWNYEMMITEKLLSADARNFHGWHYRRYVVSQIERAGNCSLAKKEMEYTTSAIATNFSNFSALHNRTKLIETILNLEADPNSQKALAKQILEQELDMIHQAVFTDPDDSSVWIYHRWLMGHCNPNSMTPLISMITIEERIQYLQKEIELIQELHEMEPENRWCCESLVNYEALCKTLEKQKPTEADIKRWTLLVDKMIKVDPQRRGRYRTLQEKINNLNK

SEQ ID NO: 22048 - protein, 338 aa, Dianthus caryophyllus
MAPIKIGINGFGRIGRLVARVILQREDCELVAVNDPFITTEYMTYMFKYDSVHGQWKHHDIKVKDEKTLLFGEKAVTVFGNRNPEEIPWGGTGADYVVESTGVFTDKDKAAAHLKGGAKKVIISAPSKDAPMFVVGVNEHEYKPELDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRIEKPATYEQVKAAIKEESEGKLKGILGYTEDDVVSTDFVGDNRSSIFDAKAGIALNDNFIKLVSWYDNEWGYSTRVVDLIAHIHKTCQ

SEQ ID NO: 22049 - protein, 337 aa, Phaeosphaeria nodorum
MVVKVGINGFGRIGRIVFRNAIEHNDVEIVAVNDPFIEPHYAAYMLKYDSQHGQFKGDIKVEGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAVKAAADGPLNGILGYTEDEIVSTDLNGDTRSSIFDAKAGISLNKNFVKLVSWYDNEWGYSRRVLDLLVYIAKVDGNA

SEQ ID NO: 22050 - protein, 202 aa, Glycine max
MGLSILRSTSISTPISSSKSKPIFSTLVRSSFASISPTKCVTPTTLFVSATPFFTASPKRGFRGGIVAMAAAGSLRKSEEEWRAVLSPEQFRILRQKGTEFPGTGEYDKFFDEGVYNCAGCGTPLYRSLTKFNSGCGWPAFYEGIPGAINRNPDPDGMRTEITCAACGGHLGHVFKGEGFPTPTNERHCVNSISLKFAPANS

SEQ ID NO: 22051 - protein, 429 aa, Oryza sativa
MATGKSGGSSAEDLGHHAGYYRLPNTHDARLFYFFFESRGSKGEDDPVVIWLTGGPGCSSELALFYENGPFHIADNMSLVWNDFGWDQESNLIYVDQPTGTGFSYSSNPRDTRHDEAGVSNDLYAFLQAFFTEHPNFAKNDFYITGESYAGHYIPAFASRVYKGNKNSEGIHINLKGFAIGNGLTDPAIQYKAYTDYSLDMGLITKSQFNRINKIVPTCELAIKLCGTSGTISCLGAYVVCNLICSSIETIIGKKNYYDIRKPCVGSLCYDLSNMEKFLQLKSVRESLGVGDIQFVSCSPTVYQAMLLDWMRNLEVGIPELLENDIKVLIYAGEYDLICNWLGNSRWVNSMEWSGKEAFVSSSEEPFTVDGKEAGILKSYGPLSFLKVHDAGHMVPMDQPKVALEMLMRWTSGNLSNASSSFQRLDFTM

SEQ ID NO: 22052 - protein, 354 aa, Agrobacterium tumefaciens str. C58 (Cereon)
MITKTPLTFHGEGDSALLTGPDHLPVRAWPQKEQFAASRPSGAIARGIVVRHRRCSMSLDRLAPAIFVFLWSTGWVTAKYAVYYTGPLTFLCLRYLLAGLLLWAICRFSGISWPKQRADVLRAILSGVFLHGIYLGMIWWAIGQGVPAAIGGIIAGLQPLMTAVAARFMIGERISPLQRAGLLLGFAGIAIAVLPKVMATGALGMSVPLYAVAVNVLGMVSVTYGTLYQKKYVHGGNIMAVATLQYVGALLVTVPFALLLEDGHVDWSLGLAATLGWSVGAISIGAVALLLYLIRRGQVSRAASLIYLVPPLAAVEAAVLFGETLTPAMIAGTVLAVTGVYLANRKPAASVAVR

SEQ ID NO: 22053 - protein, 333 aa, Vibrio parahaemolyticus RIMD 2210633
MTIKVGINGFGRIGRLALRAAFDWPELEFVQINDVAGDAATLSHLLEFDSVQGRWHHEVQVEGNELVINGKRIATTQHRDIDAVNWSGCDVVIEATGVHRKTSYLDQYLDQGVKRVVVSAPVKEEGIANIVVGVNDHIFDPDKHRIVTAASCTTNCIAPVVKVIHEKLGIEQSSFTTIHDLTNTQTILDAPHKDLRRARACGMSLIPTTTGSATAIVEIFPDLKGKINGHAVRVPLANASLTDIIFDVKRDTTAEEVNALLKEASDGELKGILGFEERPLVSIDYKGDQRSTIVDALSTMVVGSRMVKIYAWYDNEMGYATRTAELVRNVGLA

SEQ ID NO: 22054 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGVRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 22055 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 22056 - protein, 204 aa, Xylella fastidiosa Dixon
MHLISNDFKNGQPIPVECAAGQTDGFAPNRNPHLAWDDVPENTRSFALLCIDPDVPSIPETIGRTDMEIPVTQPRIDFVHWVMTDISTNLRMIAHGSCSDGFVVGGKTMPPGPAGTHQGLNDYTKFFANTPEMAGDYYGYDGPYPPFNDLRIHRYLFRLFALDLEHLPLPKRFDGPTLLRTIQGHVLTEATLYGTYTLNPKAQE

SEQ ID NO: 22057 - protein, 121 aa, Zea mays
PQRRQASCGGRCPWLPRGVSNSANPITVTLNFYGNGPANQGQFFKARSPPALGRLPVLWVCENNHYGMGTAEWRASKSPAYYKRGDYVPGLKVDGMDVLAVKQACKFAKEHALENGPIVSI

SEQ ID NO: 22058 - protein, 362 aa, Lolium perenne
MVQPVFDAALLSAQSDIPSQFIWPADESPTPDATEELHVPLIDIGGLLSGDREAAAEVTRLVGDACERHGFFQVVNHGIDAELLGHARCVDAFFTMSLQDKQRALRRPGESCGYASSFTGRFASKLPWKETLSFRSCPSEPDLVVDYIVATLGEDHRRLGEVYARYCSEMSRLSLEIMEVLGESLGVGRAHYRRFFEGNESIMRLNYYPPCQRPNETLGTGPHCDPTSLTILHQDDVGGLQVHADGRWLSIRPRADAFVVNIGDTFMALSNGRYKSCLHRAVVNSRVPRKSLAFFLCPEMDKVVAPPGTLVDEANPRAYPDFTWRALLDFTQKHYRADMKTLEVFSDWIQQGHQPAATTTTT

SEQ ID NO: 22059 - protein, 356 aa, Nitrosomonas europaea ATCC 19718
MKIALLAGDGIGPEIMAQAERVLRYFQQEGLQIELEPGLLGGCAVDATGEPFPEATRQLAIEADAILLGAVGGTQYDGLPREKRPEQGLLAIRKELNLFANLRPVVLYPELSNASTLKPEVVAGLDILIVRELTGDIYFGRPRGIEYRDGQKVGFNTMIYSESEIRRIAHVAFQAAGRRNGRLCSVDKMNVLECTQLWRDVVTETAQSYPDVTLSHMLVDNAAMQLVRNPRQFDVVVTGNMFGDILSDEASMLTGSIGMLPSASLDDRNKGLYEPIHGSAPDIAGKGIANPLATILSAAMMLRYSFNQETAASRIEHAVQKTLQQSYRTEDIYEAGMKKVGTVEMGDRVLANLQSR

SEQ ID NO: 22060 - protein, 508 aa, Zea mays
  unsure (1)..(508): unsure at all Xaa locations
MFLESFRVESPRVKYGDGEIQSEYRYDTTEVVPPGNGGGAGWVVRPKSVTYNFKTSTNVPKLGVMLVGWGGNNGTTLTAGVIANREGISWETKEKVHKANYFGSLTQASTIRVGSHNGEEVYAPFKSLVPMVDPNSIVFGGWDISKLNMADAMARAKVLDFHLQKQLRPYMESMLPLPGIFNPDFVAANQGARADNVIKGTKKEQVEQIKKDIKEFKEKNKVDKVVVLWTANTERYSNVVAGLNDTMDKLLASLDKNEAEISPSTLYAIACVLEGVPFVNGSPQNTFVPGLMELAIKKNSVIGGDDFKSGQTKMKSVLVDFLVGAGIKPTSIASYNHLGNNDGMNLSAPQVFRSKEISKSSVVDDMVASNPILYKPGEHPDHVIVIKYIPYVGDSKRAMDEYTSEIFMGGKNTIALHNTCEDSLLAAPIILDLVLLAELSTRIQLKAEGQDKFHSFHPVATILSYLSKAPLVPPGTPVVNALAKQRAMLENILRAXCIGLAPENNMMA

SEQ ID NO: 22061 - protein, 405 aa, Glycine max
IRLEATQNKIRRVFAFTDSELLHDQITFGKKLEMPLLTALRERILELANNFEDFVLNLIPSTDLEQPLHLAKVAIGLVTFPVNGEILLKNCSICCDDKPVPIMITLKCLHTFCSHCLRAYADGKVQSCQFPIRCPQPRCKYCMSVTECRSFLPFISFGSLEKALSEENIDHSDRIYCPFPNCSVLLDPHECSSARASSSSQSDNSCIECPVCRRFICVDCKVPWHSSMSCLEYQNLPEKERDVSDITLHRLAQNKRWKRCQQCRRMIELTQGCYHMTCWCGYEFCYSCGAEYREGQQTCQCAYWDEDNSEDSVAHSLQESEQWAWETFNSLSMIVDAYSDQERSQLALIQRFLAGGFSLSDHNPYQSPPRCTDSYVDPMKDLHQLPWLERFVSVISDNYYDDYIQ

SEQ ID NO: 22062 - protein, 628 aa, Gossypium hirsutum
MGKFSIPKLGFLLLCCLAALTEATYVKYKDPKQPLGVRIKDLMRRMTLAEKIGQMTQIERTVATPDAMKNYFIGSVLSGGGSVPAQKATPETWIEMVNTMQKASLSTRLGIPMIYGIDAVHGHNNVYKATIFPHNIGLGVTRDPNLVKRIGEATALEVRATGIPYVFAPCIAVCRDPRWGRCYESYSEDHKIVQMMTEIITGLQGGLPVHSKKGVPFVAGKNKVAACAKHYVGDGGTTKGINENNTVISWNGLLGIHMPAYFNSIAKGVATIMTSYSSWNGKKMHANHDLVTDFLKNKLKFRGFVISDWQGLDRITSPPHANYSYSVEAGVGAGIDMVMVPYNFTEFIDDLTYQVKNNIIPMSRIDDAVKRILRVKFVMGLFENPMADNSLVNQLGSQEHRELAREAVRKSLVLLKNGESADKPLLPLPKKATKILVAGTHADNLGYQCGGWTITWQGLGGNDLTTGTTILQAVKNTVDSSTQVVYSENPDAGFVKSGEFSYAIVVVGEPPYAETYGDSLNLTISEPGPMTIYNVCGSVKCVVVVISGRPVVVQPFVSSVDALVAAWLPGTEGQGVSDVLFGDYGFTGKLARTWFKTVDQLPMNVGDPHYDPLFPFGFGLTTKPTHQN

SEQ ID NO: 22063 - protein, 187 aa, GIBBERELLA ZEAE PH-1; identical to SEQ ID NO: 21778

SEQ ID NO: 22064 - protein, 251 aa, Fusobacterium nucleatum subsp. nucleatum ATCC 25586
MRRLVIAGNWKMYKNNKEAVETLTQLKDLTRDVKNVDIVIGAPFTCLSDAVKIVEGSNVKIAAENVYPKIEGAYTGEVSPKMLKDIGVTYVILGHSERREYFKESDEFINQKVKAVLEIGMKPILCIGEKLEDREGGKTLEVLAKQIKEGLVDLSKEDAEKTIVAYEPVWAIGTGKTATPEMAQETHKEIRNVLAEMFGKDVADKMIIQYGGSMKPENAKDLLSQEDIDGGLVGGASLKADSFFEIIKAGN

SEQ ID NO: 22065 - protein, 504 aa, ASPERGILLUS NIDULANS FGSC A4
MAQPVQLTAPNGVSYSQPTGLFINNEFVPAASGKTLTTVNPYDESIIATVSSAGPKDVDRAVAAARQAFASEWRGLTPSERGLLLLRLADLCDRDKEILATIDAWDNGKPYEQALGEDIAEVIAVFRYYGGWADKIHGSTIDTGDAKFAYTRHEPLGVCGQIIPWNYPVMMAAWKLGPALACGNTVVLKAAEQTPLSVLYLATLIKEAGFPAGVVNLLNGEGASAGAAIAGHPGVDKIAFTGSTNTGRVIMKAAAGNLKAITLETGGKSPLLVFDDANIDQAVKWSHVGIMSNMGQICTATSRIYVQETIYDTFVEKFKQYTIENSKVGSQFDPSVTHGPQISKAQRDRILSYVQSAKSEGAQLVLGDEPVSEKGYFVPPTIFKNTTREMSAVREEIFGPFVVIQSFSTQQDAINKANDTEYGLGAAVFTENITRAHRVAAAIQAGMVWINSSQDSHFAIPFGGYKQSGIGRELGEYALAAYTQVKAVHGKFSLPLEFNLGTWL

SEQ ID NO: 22066 - protein, 509 aa, Halomonas sp. SK1
MSDDTKKCPVTHMTTDFGAPVVTNRDSLTAGPRGPLLAQDVWLNEKLAGFVREVIPERRMHAKGSGAFGTFTVTHDITKYTRAKIFSEVGKKTEMFARFTTVAGERGAADAERDIRGFALKFYTEEGNWDMVGNNTPVFFIRDPRQFPDLNKAVKRDPRTNLRTATNNWDYWTLLPEALHQVTVVMSDRGIPASYRHMHGYSSHTYSLWNQAGERFWVKMHFRTQQGIKNLTDAEAGELVAQDRESHQRDLYEAIERGEYPKWTMFIQVMPEADAEKYALHPFDLTKVWYKGDYPLIEVGEFELNKNSENFFADVEQVAFSPSNLVPGIGVSPDRMLQRRLFNYADAQRYRLGVNYHQIPVNQARCPVHSNHRDGQGRVDGNYGALPHYEPNSFGQWQGQPQFSEPPLKLTGNAAHWSYDKDDHNYFEQPGKLFRLMNDGQKEALFGNTGRAMGDAPEFIKFRHIRNCHAADPAYGAGVAKALGINLEKALASKKDDPMYGNPLVALPA

SEQ ID NO: 22067 - protein, 196 aa, Triticum aestivum
  unsure (1)..(196): unsure at all Xaa locations
MAPTVMASSATSVAPFQGLKSTAGLPVSRRSNGASLGSVSNGGRIRCMQVWPIEGIKNSETLSYLPPLNTEXLLKQVDYLIXRSKWVPCLQFNKVGLSSRLSTTHPLGYYDGRYWXTMWKLPMXFGCTDPPSVNKVEEXKKXIPDAYFRIIXSTNRKAQIAHGRSGKAKNITRHIKAGFRILGFLHYFCFQKKVSQ

SEQ ID NO: 22068 - protein, 302 aa, Escherichia coli O157:H7 EDL933
MAAINTKVKKAVIPVAGLGTRMLPATKAIPKEMLPLVDKPLIQYVVNECIAAGITEIVLVTHSSKNSIENHFDTSFELEAMLEKRVKRQLLDEVQSICPPHVTIMQVRQGLAKGLGHAVLCAHPVVGDEPVAVILPDVILDEYESDLSQDNLAEMIRRFDETGHSQIMVEPVADVTAYGVVDCKGVELAPGESVPMVGVVEKPKADVAPSNLAIVGRYVLSADIWPLLAKTPPGAGDEIQLTDAIDMLIEKETVEAYHMKGKSHDCGNKLGYMQAFVEYGIRHNTLGTEFKAWLEEEMGIKK

SEQ ID NO: 22069 - protein, 326 aa, Clostridium magnum
MSISNSKIIDMYKTMLKIRKFEEVAMNASAEGRIPGFIHLYIGEEAVATGVCANLNDKDYITSTHRGHGHIVAKGGDLKLMMAELFGKATGYCKGRGGSMHIADATKGILGANGIVGAGHDLALGAGLSAQYRGTNEVCICFFGDASTNQGTFHEALNMASVWKLPIVFVCENNGYGISTSQKRHMAIKDVADRGVGYNVPGVVVDGNDVFAVYEAAGEAIKRAREGKGPTLLECKTYRHRGHFEGDPMTYKPKEEQDMWLKKDPIPRFEKHILNNEVLSEEGIKEVQDDIENQIKEAVAFADNSPIPNVETALEDVYSDIKDQGR

SEQ ID NO: 22070 - protein, 302 aa, Rhodospirillum rubrum
MRSRQTALDGLAMSLLVVLCASWGVQQVAIKVASAGISPMFQAGLRSAGALGLLWAWSAARGVPILARDGSLGLGLVIGLLFGGEILFIYWGLSYTTAARSVLFLYTAPFFVALGAHVFLPGERLRRTDILGLACAFAGVLAVVADGLTLPDRRAMIGDAMVLLAAILWAATTVVIKASPLAGLSANKTLVYQLGVSAVLLLGLSAGLGEAGLFDPTPRVLAAMAYQTIGVAFASYLVWFWMITRYPASKLSAFSFLTPVFGVLAGAVMLGERVSSGLALAMGLIGFGIFLINRPERRETVA

SEQ ID NO: 22071 - protein, 477 aa, Neuroglossum binderianum
KNDRYGSGVIPYAKMGYWDPDYVIKETDILALFRVSPQPGVDPVEASAAVAGESSTATWTVVWTDLLTACDLYRAKAYKVDPVPNTSDQFFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSIEAVNRSIAATGEVKGHYMNVTAATMENMYERAEFAKQLGTVIVMIDLVVGYTAIQTMGIWARRNDMILHLHRAGNSTYSRQKIHGMNFRVICKWMRMAGVDHIHAGTVVGKLEGDPKMIKGFYDTLLEPYLAVNLPEGIFFEQDWASLRKVTPVASGGIHCGQMHQLLDYLGNDVVLQFGGGTIGHPDGIQAGATANRVALEAMVIARNEGRDYVKEGPQILRDAAKTCGPLQTALDLWKDITFNYTSTDTADFVETPTANV

SEQ ID NO: 22072 - protein, 190 aa, Ralstonia metallidurans
MSNSIIQSPDLGDVTGYLRDRIRTVPDWPQPGVMFRDITPLLQNPKTLRVLIDVFVHRYMDQNLDLVAGIDARGFILGSIIAYELNLGFVPIRKKGKLPFQTVAEEYELEYGSATVEIHADACKPGDRVLLIDDLIATGGTMMAGRKLLERLGATVVEGGAIVDLPELGGSKLLQASGLSLFTVCNFDGH

SEQ ID NO: 22073 - protein, 339 aa, Hordeum vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 22074 - protein, 233 aa, Oryza sativa (indica cultivar-group)
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGCSIEELRGLEMKLEKSLHNIRLKKTELLERQIAKLKEKERTLLKDNENLRGKHRNLEAAALVANHMTTTTAPAAWPRDVPMTSSTAGAADAMDVETDLYIGLPGTERSSNRSETG

SEQ ID NO: 22075 - protein, 400 aa, Synechocystis sp. WH 8501
MLEVEKTVKQTNVGLKELLIQLQELTTTKFSGSLQITIGNCPNWVLWLRLGRLSWSDGGVNSQERWQRHLASFVPELQGSQLHEITSIDNQYDRCHILVQLLDQGLLQRQQLTESMLSVTQEIFFDLIQSNHINRNCLSYEIIPDDSSNKHTSLLPMIEVMPNLKQSLKTWQKWQNQNLAGYSPNLFLLIKQPELISQENLSESQLSIISLIDGSQNVRILALKTGLDIVSVMLCLLPLTKLKAISFSKIPFSKIPIHQNSDISHLGVADNQKTLIACVDDSLGVCRALEKIISEQGFGFVGIQEPLKAIPSFLKTKPDLIFLDLVMPITNGYELCTQLRKTPSLKNVPVVILTGKDGLVDRMRAKMVGSNDFLSKPIKMPELLKVLNKHLTQSTQKEST

SEQ ID NO: 22076 - protein, 158 aa, Glycine max
  unsure (1)..(158): unsure at all Xaa locations
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 22077 - protein, 394 aa, Zea mays subsp. mays
LGAERRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTSL

SEQ ID NO: 22078 - protein, 485 aa, Euglena gracilis
FFSILPIMANNTADIQYLRQHNIPELVNDLIQQLVTTKPAQPVAFLRDVLSKRKAVIKVVKARQILDSRGNPTVEVDVILDNGVVGRGAVPSGASTGEYEAVELRDGDKKVYLGKGVLKSVNAVNTLVAPKLIGLDPANQREIDELMKQIDGTPNKGKIGANGILGVSMACCRAAALTQGIPLWKHIANLHGNKDNFQLPVPMCNIINGGKHADNKIDFQEFMIMPIGAKSFSEGLRWVTEIFHTLKALLKKAGHVTSVGDEGGFAPDLSNDEALEFVMKAIKAAGYTPGTQIGVALDCASSELFDEGGRKGYKFWKSNPSKLFSAQEMIDIFCRWCDEYPIVSIEDPLDQNDWDGYVNMTKKMGRRTQIVGDDFFVTNPARFSKGIGMNACNAILIKVNQIGTVSETLECIKMAQAHGYGSIASHRSGETEDAFIADLAVGTGCGQIKTGSLSRTDRMAKYNQLIRIEEELGAQAKWTTKHLVR

SEQ ID NO: 22079 - protein, 81 aa, Viscum album subsp. album
GFAWSWGPLGWLVPSEIFPLEIRSAAQSVNVSVNMFFTFLIAEVFLTLLCHMKFGLFLFFGVFVLIMSAFVFFFLPETKGI

SEQ ID NO: 22080 - protein, 257 aa, Microbulbifer degradans 2-40
MNTNTKRKPIVIANWKLNGGLELICTSVASFIGKHFEADIAICPPYIYMRDMLTFLQHSEISIGSQNVSKFKSGAYTGETSAQMLKEAGCKLCLIGHSERRSMFKENNLSCQIKIGNALNHGLMPILCVGENKEEHDAKITKDVIFRQVTECLEGVELDGRKICIAYEPIWAIGTGASATPEIAQDVHSFIRQELIKLYGEETANSIRLLYGGSVTKDNAKDLLAKEDVDGLLVGGASLDPGHFLAICQHASDSSAS

SEQ ID NO: 22081 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 22082 - protein, 193 aa, Triticum aestivum
MAFASSLLPAPASGVRASHAPELAFPPVNRKGGVSLRRRGARHGVRAEVNESASAVAIDALSQVKHVLLPITDRNPYLSEGTRQAAATTTSLAKKYGASITVVVIDDKPKESFPEHDTQMSSIRWHLSEGGFTEFGLMERLGEGKKPTAIIAEVADDLELDLVVLSMEAIHSKHVDGNLLAEFIPCPILVLPL

SEQ ID NO: 22083 - protein, 387 aa, Gaeumannomyces graminis var. tritici
MLRSSAFALLAWASLSEAQFGIKHTQYGTSEPVYPSPEISGSGGWEAGLTKAKDFVAQLTPEEKANMVTGTPGPCVGNIAPVPRLNFTGLCLQDGPATLRQATYVTVFPGGVSAASSWDKDLIYKHGVLMAREFRDKGSHIILGPVIGPLGRSPYAGRNWEGFSPDSYLAGVLAEQTVKGMQSVGVQTCTKHYIGNEREEQRNPTTVDGRGVEAISSNIDDRTMHETYLWPFYNAVRAGTTSIMCSYQRINGSYGCQNSKTLNGLLKTELGFQGFVVSDWAATHSGVASIEAGLDMNMPGPLNFFAPTLESYFGKNITTAVNNGTLSPRRADDMIERIMTPYFALGQDKDYPPVDGSTVPISYLQPDAWNHEFPLGPTVDVRRNHHE

SEQ ID NO: 22084 - protein, 243 aa, Triticum aestivum
  unsure (1)..(243): unsure at all Xaa locations
GIISAIGISIVVGWGYILGVTFAVKDIPSLLSPDNEAGGYAIAQVFYQAFKSRYGSGVGGIVCLGIVAVAIYFCGMSSVTSNSRMAYAFSRDGAMPLSSVWHKVNEHEVPINAVWLSAFVSLCMALPSXLGSLVAFQAXVSIATIGLYIAYALPIFFRVTLARKHFVPGPFNLGRYGVLVGWVAVLWVVTITVLFSLPVMYPVTRDTLNYTPVAVGGLFILVLTSWVVSARHWFKGPVTNLSG

SEQ ID NO: 22085 - protein, 364 aa, Saccharomyces cerevisiae
MSAPKKIVVLPGDHVGQEITAEAIKVLKAISDVRSNVKFDFENHLIGGAAIDATGVPLPDEALEASKKADAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 22086 - protein, 356 aa, Micromonospora echinospora
MELTTTAARPGLRHRMQQLIYGFFTAQTLHVAVRLRIPDLLADGARDVGDLASATGADAPSLRRLLRALVFLEVLDEPAPGTFALTEQGEVLRADVTGSMRELVLLLSGPESWAAWGQLEHSVRTGEVAWEHVHGRSCFDHLMADPQRQAAFNAAMAEGSRAFVPTLLSAYDFGDLRTVVDVGGGSGALLAGVLAAHPHLRGTVFDTPDGVADAARTVAEQGVADRCGVETGDFFVSVPPGADAYVLKSVLHDWDDEQCVEVLRTVRRAVRPDSRVILVESLMPTTVTTAPSVAQVVMNDLNMMVCHGGRERTVAEFRELLRVAGFRLESVTPCPAPSVVGILEAAPAPATGPDGS

SEQ ID NO: 22087 - protein, 112 aa, Glycine max
  unsure (1)..(112): unsure at all Xaa locations
MASSMISSPAVTTVNRAGAGMVAPFTGLKSMAGFPTXKTNNDITSIASNGGRVQCMQVWPPVGKKKFETLSYLPDLDDAQLAKEVEYLLMKGWIPCLEIQLEQRFVFREPHQ

SEQ ID NO: 22088 - protein, 332 aa, Thermotoga maritima
ARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 22089 - protein, 253 aa, Streptococcus agalactiae NEM316
MISRKVALVTGASAGFGAAIVTKLVSDGYSVIGCARRMDKLKCFGEKFSEGYFYPLQMDITSRESVDKALESLPKNLQSIDLLVNNAGLALGLDKSYEADFEDWMTMINTNVVGLIYLTRCILPKMVEVNRGLIINLGSTAGTIPYPGANVYGASKAFVKQFSLNLRADLAGTKIRVTNLEPGLCEGTEFSTVRFKGDHKRVEKLYEGAHAIQAEDIANTVSWVASQPEHININRIEIMPVSQTYGPQPVYRD

SEQ ID NO: 22090 - protein, 318 aa, Streptomyces avermitilis MA-4680
MPDSVETFDLITMGRIGVDLYPLQPGVPLPQVESFGKFLGGSAANVAVAAARLGRSTAVITRTGNDPFGTYLHQALEEFGVDDRFVTPVDAYPTPVTFCEIFPPDDFPLYFYRQPKAPDLEIRTEELDFFALRAARIFWITGTGLSEEPSRSATLAALKARTKGGTTVFDLDWRPMFWQDPRAARPYYAEALRHATVAVGNLDECEIATGVREPRACAEALIEAGVELAVVKQGPKGVLAVHRDGTTAEVPPVPVEVVNGLGAGDAFGGSLCHGLLAGWELERTMRYANAAGALVASRLACSSAMPTLDEVEDLVARG

SEQ ID NO: 22091 - protein, 547 aa, Oryza sativa
MESSAAENWWVLPLTFLPPISGQNESAATLSAMATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPYWRALRRVAAGHLFGPRQVDAFAPYRARVAGGVVAALRGAGGEAAVQVRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 22092 - protein, 348 aa, Synechocystis sp. WH 8501
MTSVQIPVIPEQSLDRECTTLSRHVLQQLQSFSPEAQDLSAIMNRIALAGKLISRRLSQAGLMADVLGFTGETNVQGESVKKMDVYANDVFISVFKQSGLVCRLASEEMDKPYYIPENCPIGRYTLLYDPIDGSSNVDINLNVGSIFAIRQQSGEDLDGEATDLLQDGRGQLAAGYIVYGPSTMLVYTIGHGVHSFILDPSLGEFILAQENIQIPDHGPVYSTNEGNFWQWDEAIRDYTRYVHRHEGYTARYSGALVGDIHRILMQGGVFLYPGTVKKPEGKLRLLYETAPLAFLMEQAGGKASDGVKPILDVVPDKLHARSPLVIGSKEDVSLVESFIQDHQRRGNA

SEQ ID NO: 22093 - protein, 841 aa, Prochlorococcus marinus str. MIT 9313
MSSSHPLDLRLPTPGCFADPERAGLDADAVFDGMTEHLFFTLGKLAPTASNHDLYMALSYAVRDRLMTRYLASLEAIRARPHKTVAYLSAEFLIGPQLNSNLLNLGISKEIAEQALRRFRIESLDQILEVEEEPGLGNGGLGRLAACYMESLASLQVPAIGYGIRYEFGIFNQLIRDGWQVEVTDKWLKGGWPWELPQPEEACFVGFGGRTESYTDGKGNYRSRWIPSEHAIGIPHDVPVLGYRVNTCNRLRLWRADATESFDFYAFNIGDYYGAVEEKVGSETLSKVLYPNDGTDEGRRLRLKQQHFFVSCSLQDMLRSLGNRGIPIEEFPNHWTVQLNDTHPAIAVAELMRLLIDEHYLDWDTAWDITTRSVAYTNHTLLPEALEKWDLTRFASLLPRHLELIYEINRRFLQQVRLRYPGNDAIQRKLSIIDEDGGKAVRMANLATIAAHHVNGVAALHSDLLKRQLMPEFAEIWPEKFTNITNGVTPRRWVALANPALSRLLDEHVGPEWITNMELLTKLEERQHDTAFLEQWGATKLSVKRKLAGYIHRQTGVLVDPSSLFDVQVKRIHEYKRQHLNALQVITHYLRIKNGQANGMAPRTVIFGGKAAPGYYMAKLIIRFINGIAETINADPDMEGRLRVVFLPDYNVKLAEQIYPASDLSEQVSTAGKEASGTGNMKFAMNGALTIGTLDGANVEIRERVGPENFFLFGKTETEIMELQTKGYRPRQIVETLPELAEALRLIGLGHFSNGDGELFRPLLDNLTGFDPFFVLADFADYLRAQDEVNQAWTNRKQWNRMSLLNTARTGFFSSDRSIQDYCQTIWKAEPFPVEITCDVP

SEQ ID NO: 22094 - protein, 414 aa, Cyanidium caldarium
MAFLSTSCVNLVGSHRCYKDKTSQAICQRSFLKRRSFLCGSDSTGYSLFTSSFVSYHNRDLDLSSKTNANQRWVMQAKVRVAINGFGRIGRNFLRCWATRPSSHLDVVAINDTTGAKTAAHLLKYDSILGTFEKDVRAGEDCITVDGKEIKVVSNRDPLQLPWKDLNIDLVVEATGVFVDSKGAGKHLQAGAKKVLITAPGKGEDVGTFVIGVNEHSYDHQVHHIVSNASCTTNCLAPFIKVLHEEFGIVKGTMTTTHSYTGDQRLLDAAHRDLRRARSAALNIVPTTTGAAQAVALVIPELKGKLNGLALRVPTPNVSVVDMVCQVGRKTFKEEVNGAFLKASQGSLRGILRYSDEQLVSCDYRKTNESSIIDASLTMVLGDDLVKVVAWYDNEWGYSQRVVDLGELMASKWK

SEQ ID NO: 22095 - protein, 175 aa, Oryza sativa; identical to SEQ ID NO: 3706

SEQ ID NO: 22096 - protein, 366 aa, Triticum aestivum
  unsure (1)..(366): unsure at all Xaa locations
TVAARVALARPLSRRPPVRLPSSWFWLVWWLLRASSSEPPSLAHQPHHHRSARRRERFDSGRREWRRRRPSPPPTSPASPPPPRPRSTTTRTTSSASAAPAAXAQRLVAMAGSGKFFVGGNWKCNGTKESITKLVSDLNAATLESDVDVVVAPPFIYIDQVKSSLTGRIEVSAQNTWIGKGGAFTGEISAEQLVDIVVESVILGHSERRNVIGEGDQVIGKKTAYALRGDLKVVACIGELLEEREAGKTFDVCFKRMNVFADDKTVWKKDAIAYEPECAIGTGKVASLEETQEVHAAVRDWLKTXNVSADVASTVRIIYGGSVNAANCAELAKKEDIDGFLVGGASLKGSDFATICNSVTSKKVTA

SEQ ID NO: 22097 - protein, 150 aa, Gibberella zeae
WRVIMGVGIGGDYPLSSIITSEFATTKWRGAMMAAVFAMQGIGQLVAALVMMFLTIGFKSSLEQAADTKSCTGDCQIAVDKMWRTLVGFGAVPACIALYYRLTIPETPRYTFDVARDVEQADEDVKAYINGKSEGNTDEVTRAQNLQSAK

SEQ ID NO: 22098 - protein, 307 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELESEK

SEQ ID NO: 22099 - protein, 307 aa, Amphidinium operculatum
RIGRLVFRAASANPDVTVKGVNDPFMDLTYMVYQLKYDSVHGRFKGTIETKTADGKEFLIVNGNEVAVFHEKDPTAIPWGASGCDYVCESTGVFTAKEKAELHLQGGCKKVIISAPPKDAVPIYVMGVNHTDYKTSDTVVSNASCTTNCLAPLAKVVNDKFGLLEGLMTTVHATTATQLTVDGPSRGGKDWRGGRCASQNIIPSATGAAKAVGKCLPALNGKLTGMAFRIPTPDVSVVDLTCRLEKPAKYDDIVAAIKEAAAGPMKGVLDWTDEEVVSTDFVSCPSSSIFDVQAGIASNDTFVKLVS

SEQ ID NO: 22100 - protein, 128 aa, Brassica oleracea
DPFEGLLTPSSARDMAAFTNARVDWKETPEAHVFKADLPGLMKEEVKVEVEDKNILQISGERSKENEEKNDKWHRLERASGKFMRRFKLPENAKMEEVKATMENGVLTVTVPKAPEKKPEVKSIDISG

SEQ ID NO: 22101 - protein, 490 aa, Burkholderia fungorum
MTRTFELGELIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLCQGNLE

SEQ ID NO: 22102 - protein, 563 aa, Eremothecium gossypii
MSHENSEDQPKVYIKTAGGNAAFHNFINDFGHIEDPLERRRLALKKIDDSSFGWYHVRAIMVAGVGFMTDSYDIFAINLGITMMSYVFWHGNMPSSTNSLLKVSTSVGTVIGQVGFGTLADVVGRKRIYGLELILMILATVLQCMIGKSPAIDFVAVLTFYRIIMGIGIGGDYPLSSIITSEFSTTKWRGAIMGAVFANQAWGQITGGILALILVAAYRGDLEPAASGLECGFECQRACDQMWRILVGFGCVPGMIALYFRLTIPESPRYTLDVQAADLARLANEPSRSDQEENLEKMVSPVEQVNVAPPKASFRDFCRHFSKWKHFKIILGTAGSWFMLDVAFYGMNLNTTVILETIGYAQQNNVYEKLYNSAVGNLILICAGSLPGYWFSVCTMDIIGRKPIQIGGFTILTVLFCVIGFAYDRLGEKGLLGLYVVCQFFIQFGPNVTTFIVPGECFPTRYRSTAHGISAACGKLGAIIAQTCFGTLVDHHCARDGKAKNCWLPNVMKIFALFMFCGLLLSFLIPETKRKTLEEINEQYHGEVDPGKFASHATNDANRVESV

SEQ ID NO: 22103 - protein, 528 aa, ASPERGILLUS NIDULANS FGSC A4
MVTTAQSQCRHATEVRPPEACLWPQTRFFFRNSSTSTGRSCWSAWFILANSSGGSGAFGHFEVTKDVSDLTKAHFLRSPGIKTPVFIRFSTVTLGREYPDLARNPRGFAVKFYTGEGNYDIVGLNFPVFFCRDPIQGPDVIRSQYRNPQNFLLDHNSLFDLLANTPEGNHAGMMFFSDHGTPAGWQNIHGYGCHTFKWVNAEGKFVYIKYHFLADHGQKQFNADEALRYGGEDPDYSKRELWRTIENGKELSWTAYVQVMKPEDADPEKLGFDPFDVTKVWPKKQFPLQEFGKLTLNKNPENFHRDVEQAAFSPGSMVPGIEDSPDPLLQFRMFFYRDAQYHRIGVNLHQVPVNCPFMASSYSSLNFDGQLRVDANHAMNPQYAPNSFVHKFRTDTAEAPYQLADGTVSRKSHFFHEGKASEYDQPRELYERVMDEKARQHLHTNTARLLKLVEYPKIQAKYLGQLLRISEKYARGVYDLLPEKKFGFDEVQSFAKGAEVAGKEAKFRPNMPTDKLLGLCPAMAVYGP

SEQ ID NO: 22104 - protein, 400 aa, Neurospora crassa
MLSRNSMVCLLILLLLLLSWLLRLARAVAQPTPRLARGFASVQDTPAQTLQSDIFKPTKYGGKYTVTLIPGDGIGAEVAESVKTVFKADNVPITWEQIEVSGVQDNASRTEEAFQQAVASLRRNKLGLKGILHTPISRSGHQSFNVAMRQELDIYASISLVKNLPGLQTRHKDVDLCIIRENTEGEYSGLEHQSVDGVVESLKIITRAKSERITKFAFQFALANQRKKVTCIHKANIMKLADGLFRGTFNRLAKDFPQLECNDMIVDNASMQCVSKPQQFDVMVMPNLYGGILSNIAAALVGGPGVVPGCNMGRDVAVFEPGCRHVGLDIQGKDQANPTALLLSGTMLLRHLGLDDHANRISNAVYDVIAQGKVRTRDMGGEASTHEFTRAILDSMEKSL

SEQ ID NO: 22105 - protein, 110 aa, Zea mays; identical to SEQ ID NO: 14516

SEQ ID NO: 22106 - protein, 330 aa, Wolinella succinogenes
MAKPQVTILATGGTIAGSGESSVKSSYSAGAVTVDKLLAAVPAINDLATIKGEQISSIGSQEMTGKVWLKLAKRVNELLAQKETEAVIITHGTDTMEETAFFLNLTVKSQKPVVLVGAMRSGSSMSADGPMNLYNAVNVAINKASTNKGVVIVMNDEIHAAREATKLNTTAVNAFASPNTGKIGTVYYGKVEYFTQSVRPHTLASEFDISKIEELPRVDILYAHPDDTDVLVNAALQAGAKGIIHAGMGNGNPFPLTQNALEKAAKSGVVVARSSRVGSGSTTQEAEVDDKKLGFVATESLNPQKARVLLMLALTKTSDREAIQKIFSTY

SEQ ID NO: 22107 - protein, 404 aa, Novosphingobium aromaticivorans
MRADLRAGCLRCTPLAAVVALIAAGRFVIRPLFRLIGNLGEREMFVVAALFTVMASAAVMEALGLSTALGAFVAGVMLADSPYRHELEADVEPFRSILLGLFFLAVGMMLNLHAIAERPLFVLAMAVGLIAIKAGAIFLIGLAFRMTWRGALALGLLLSQGGEFGFVLFAQAQNALLIAPDAASLFGAIVTLSMATTPFLMMATRGIREEAESPKGERAGPQPDGANAIIVGFGRFGQGVSQILLASNIPVTMVDTDIEMIDVAAEFGAKVYFGDGTRIDLLRQAGADEAEMIFFCMDGDQMSPDLVEAVHEAFPRAAIYVRAYDRRALIRLKETPASAVVREVLESAVKMARIALHDAGLSEEAINRAEDMFRARDKERLRLQVEAGDVRVARDRIITEPSGS

SEQ ID NO: 22108 - protein, 280 aa, Glycine max
  unsure (1)..(280): unsure at all Xaa locations
MDCFCCFNNQVVGGRTSCGSGKGKSHQGSVKYGFSLVKGKANHPMEDYHVAKIVKLGGQELGLFAIYDGHLGDSVPAYLQKHLFSNILKEEDFWTDPASSIIKAYETTDQAILSDSSDLGRGGSTAVTAILIDNQKLWVANVGDSRAVLSRKGVAEQMTIDHEPNTERGIIENKGGFVSNMPGDVARVNGQLAVSRAFGDKNLKSHLRSDPDIRHVDIDPDAEXLILASDGLWKVMANQEAVDIARRIKDPQKAAKQLVAESLNRESKDDISCIVVRFKG

SEQ ID NO: 22109 - protein, 189 aa, Mitthyridium sp. Streimann 56493
GGAKKVVISAPSKDAPMFVMGVNDEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIAI

SEQ ID NO: 22110 - protein, 287 aa, Pichia angusta
MEVCITTQSIDNGVGAASMFACLFTHPLDLAKVRLQTAKVPGDSLVSLAYKIVKTEGVLAAYAGLSASLLRQATYSTARFGVYEKLKGIMTDPTKGQASTFQLLAASMIAGAVGGVVGNPADVVNIRMQNDNSLPESQRRHYKHALDGLLKITREENITALFRGLGPNLARGILMTASQVVSYDVAKKLLVENLSMDPKTKATHFSASLIAGLVATTVCSPADVLKTRIMNSSGTGQSSFGILKDAISREGLGFMFRGWTPAFIRLGPHTILTFIALEELRRLKIGL

SEQ ID NO: 22111 - protein, 183 aa, Escherichia coli K12
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 22112 - protein, 330 aa, GIBBERELLA ZEAE PH-1
MVKAVVAGASGGIGQPLSLLLKTSPHIDELALYDVVNTPGVATDLSHISSRAKTTGYLPANDGAKAAFKDADIIVIPAGIPRKPGMTRDDLFNINAGIVKGLIEVAAEVAPKAFILVISNPVNSTVPISAEVLKAKGVFNPQRLFGVTTLDIVRAETFVAEITGKANPQELTIPVIGGHSGETIVPLFSKASPSVQIPDDKYDALVNRIQFGGDEVVKAKDGAGSATLSMAYAGFRFAEKVLRAVKGEKGLVEPSYVYLPGVPGGEAIAKETGCDFFSVPIELGPNGAEKATNPFEGITEKEKALLAKATEGLKGNITKGVSFVHNPPQK

SEQ ID NO: 22113 - protein, 362 aa, Azotobacter vinelandii
MSPDLPYTRYLAPDGRPLAELPAWADDFNLLTRLYRQMVLTRLFDQKAVALQRTGRIGTYAPTLGQEAIGVAIGSLMQAEDVLVPYYRDTAVQLMRGVCMEEILLYWGGDERGSDFVDPRAARDFPICVPIATQALHACGVATAFKIRGEHRVAVTTCGDGATSKGDFLEALNVAGAWQLPVVFVVNDNQWAISVPRRIQCGAPTLAQKAIGAGIHGEQVDGNDILAVCDRMRQALARARHGKGPVLLECLSYRLGDHTTADDATRYRCAEEVRQAWEEEPVKRLRAFLASQGVWDEGREQALVADCQAEVQRAVESFEAAGVQPLSSVFEHVYARWPSALAEQRETLAERLVRRQGGECHE

SEQ ID NO: 22114 - protein, 506 aa, Halomonas salina
MIYANPGSPESVVSFDARYGNYIGGEFVPPVKGQYFDNVSPVNGKPFCEIPRSTAEDIDKALDAAHAAAPAWGKTSAAERGNILLRIADRIEQNLELLAVAETWDNGKAVRETLNADLPLAVDHFRYFAGCIRAQEGTAADIDANTVAYHFHEPLGVVGQIIPWNFPILMAVWKLAPALAAGNCVVLKPAEQTPASILKLMELVGDLLPPGVVNVVNGYGAEAGQALATSTRIAKIAFTGSTPVGSHILKCAAENIIPSTVELGGKSPNIYFADIMDAEPEFIDKAAEGLVLAFFNQGEVCTCPSRALIQEDIYDAFMAKVMEKVATITRGNPLDTDVKVGAQASQEQFDKIMSYMEVAREEGAEFLTGGDKEHFDPAYDSGYYIQPTLLKGHNKMRVFQEEIFGPVVAVTTFKDEEEALAIANDTEFGLGAGVWSRDINVAFRMGRGIQAGRVWTNCYHQYPAHAAFGGYKKSGVGRETHKVALEHYQQTKNLLVSYDTNPLGFF

SEQ ID NO: 22115 - protein, 364 aa, Lycopersicon esculentum
MIFQATIQNSYDKMSDLIAFDDTKAGVKGLVDSGINKVPQVFILPPKYRVKTCETHISFPVIDLKGIDEDPIKYKEIVDKVRDASETWGFFQVVNHGIPTSILEKTLLGTRQFFEQDTEIKKQYYTRDIGEKVIYTSNLDLYSPSVPAASWRDSIFFFMAPNPPSPQEFPTACGEILMDYSKYVTELGFSLLELLSEGLGLDRSYLKDYMDYCHQSCLCHYYPSCPQPELTMGISQHSDTEFITVLLQDDIGGLQVLHQNQWFDVPPIRGALVVNIGDFLQLMSNDKYMSVEHRAIAKKDGSRMSVACFFGENPLQSSKLYEPITELLSEDNPPKYHATTVIDYKNYVLNKGLDGTSALLSYKI

SEQ ID NO: 22116 - protein, 391 aa, Shewanella oneidensis MR-1
MSQEPICQEPMSNVTVRSVPSDNSASNPLDKIVIESATLAARLARPELLELTPYQSARRLGGKGDIWINANESPFNNVAVGELDLTKLNRYPECQPPALINAYSQYSGVVESKIVASRGADEAIELLIRAFCIPGIDSIATFGPTYGMYAISAQTFNVGVKALSLSAEYGLPADFATAARGAKLVFICNPNNPTGTVIDKARIEQAIQALPDSIVVVDEAYIEFCPEYSVADLLETYPNLVVLRTLSKAFALAGARCGFLLANEEIIEIIMRVIAPYPVPLPVSEVAEQALSPAGIARMKTQVKELNTQGERLAAALNLYCEQWGGAVLKPNGNYVLAEFDDVAKVAKLLTDNGIVARAYKDPRLAKAIRFSFSSQVDTDRLVSLFESQKR

SEQ ID NO: 22117 - protein, 284 aa, Zea mays
MAACSHLAAAGGSSPAAAAVVRSPAHSSAAAAFARLRSTLRFSSAGLSVKGSRATFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPEGKKIILNFIRFIEELEKQRS

SEQ ID NO: 22118 - protein, 159 aa, Nicotiana tabacum
MSLIPSFFDGRRSNIFDPFSLNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 22119 - protein, 96 aa, Glycine max
  unsure (1)..(96): unsure at all Xaa locations
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 22120 - protein, 797 aa, Hypocrea jecorina
MVNNAALLAALSALLPTALAQNNQTYANYSAQGQPDLYPETLATLTLSFPDCEHGPLKNNLVCDSSAGYVERAQALISLFTLEELILNTQNSGPGVPRLGLPNYQVWNEALHGLDRANFATKGGQFEWATSFPMPILTTAALNRTLIHQIADIISTQARAFSNSGRYGLDVYAPNVNGFRSPLWGRGQETPGEDAFFLSSAYTYEYITGIQGGVDPEHLKVAATVKHFAGYDLENWNNQSRLGFDAIITQQDLSEYYTPQFLAAARYAKSRSLMCAYNSVNGVPSCANSFFLQTLLRESWGFPEWGYVSSDCDAVYNVFNPHDYASNQSSAAASSLRAGTDIDCGQTYPWHLNESFVAGEVSRGEIERSVTRLYANLVRLGYFDKKNQYRSLGWKDVVKTDAWNISYEAAVEGIVLLKNDGTLPLSKKVRSIALIGPWANATTQMQGNYYGPAPYLISPLEAAKKAGYHVNFELGTEIAGNSTTGFAKAIAAAKKSDAIIYLGGIDNTIEQEGADRTDIAWPGNQLDLIKQLSEVGKPLVVLQMGGGQVDSSSLKSNKKVNSLVWGGYPGQSGGVALFDILSGKRAPAGRLVTTQYPAEYVHQFPQNDMNLRPDGKSNPGQTYIWYTGKPVYEFGSGLFYTTFKETLASHPKSLKFNTSSILSAPHPGYTYSEQIPVFTFEANIKNSGKTESPYTAMLFVRTSNAGPAPYPNKWLVGFDRLADIKPGHSSKLSIPIPVSALARVDSHGNRIVYPGKYELALNTDESVKLEFELVGEEVTIENWPLEEQQIKDATPDA

SEQ ID NO: 22121 - protein, 485 aa, Chloroflexus aurantiacus
MMDYPFFHVSHYIDGQFVDGGSRFDILYPATNQVIGSAPEAGADEVDAAVAAASRAFRQWSRMPAAERRLILKRFAQLIRDHEAELAAIETWDVGRPITENRSGYIPRIAANIEFFADFAVTHGSESYPMDNGYINYVLRQPVGVAALIAPWNIPLLQATWKMGPALAFGNTVVLKPAELTPIGTWRLAQLAHAAGVPAGVINVIHGFGPNSAGALLTRHPDVKLISFTGETTTGKIIMATAAPTLKRVSFELGGKGANIIFADADLDRAVAISLRSSFFNQGEFCLAGPRLLVQRPIYEAFLTRFQRATSQLQVGDPFDPQTRVGALISREHYERVTGFIDLARADGAHILTGGTDPVLPEPFAQGNFLQPTIITDVKPHDQVCQDEIFGPVVTVVPFDDEEEAIAIANGVSYGLSAVVQTRDVGRAVRMGSALEAGTIWINDFFVRDLRVPFGGMKQSGIGREGGHYSLEFYTEAKTICLSNQ

SEQ ID NO: 22122 - protein, 494 aa, Pisum sativum
MDPYKHRPSSAFNSPFWTTNSGAPVWNNNSSLTVGSRGPILLEDYHLVEKLAQFDRERIPERVVHARGASAKGFFEVTHDISHLTCADFLRAPGVQTPVIVRFSTVIHERGSPETLRDPRGFAVKFYTREGNYDLVGNNFPVFFVHDGMNFPDMVHALKPNPQTHIQENWRILDFFYNFPESLHMFSFLFDDVGVPQDYRHMDGFGVNTYTLINKAGKSVYVKFHWKPTCGVKCLLEEEAIQVGGSNHSHATKDLYDSIAAGNYPEWKLYIQTIDPAHEDRFEFDPLDVTKTWPEDIIPLQPVGRMVLNKNIDNFFAENEQLAFCPAIMLPGIYYSDDKMLQTRVFSYADSQRHRLGPNYLQLPVNAPKWSHHNNHHEGFMNAIHRDEEVNYFPSRHDTVRHAERVPIPTTHLSARREKCNIPKQNHFKQAGERYRTWAPDRQERFLRRWVEALSDTDPRITHEIRSIWVSYWSQADRSLGQKLASHLNMRPSI

SEQ ID NO: 22123 - protein, 455 aa, Mycobacterium tuberculosis H37Rv
MSTTQLINPATEEVLASVDHTDANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 22124 - protein, 314 aa, Sinorhizobium terangae
VMFDGSSISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 22125 - protein, 196 aa, Vibrio parahaemolyticus RIMD 2210633
MANIVFIDNFDSFTYNLVDQFRSLGHSVKIYRNHIPAETIEQAINELENPVVLLSPGPGAPSEAGSMPELIQRMKGKVPMIGICLGHQAIVEAYGGTVAGAGEIIHGKVSMMEHQDHAIYQNLPSPLAIARYHSLVATKVPDSLTITAEVDNLVMSVVHEQDKVCGFQFHPESIMTTYGATLLGNAIEWALEKNNA

SEQ ID NO: 22126 - protein, 490 aa, Arabidopsis thaliana
MMGSILLLLLFFSLVQSRSDTSYSKIQLPGDSLTLSVTDFGATGDGINYDTSAIQSTIDACNRHYTSFSSICRVVFPSGNYLTAKLHLRSGVILDVTENAVLLGGPRIEDYYPAETSSDWYVVVANNATDVGITGGGAIDGQGSKFVVRFDEKKNVMVSWNQTGACLGDECRPRLVGFVDSINVEIWNITLREPAYWCLHIVRCENTSVHDVSILGDFNTPNNDGIDIEDSNNTVITRCHIDTGDDAICPKTYTGPLYNLTATDCWIRTKSSAIKLGSASWFDFKGLVFDNITIFESHRGLGMQIRDGGNVSDVTFSNINISTRYYDPSWWGRAEPIYITTCPRDSSAKEGSISNLLFVNITIDSENGVFLSGSPNGLLSDIKFKNMNLTFRRWSNYSAGLVDYRPGCQGLVNHRATSGIIMEHVNGFRVENVDLKWSDDDDVNAAWNVPLEFRPSTVNNVSFVGFTSGLYTKLFESDYVMVGENNIAFA

SEQ ID NO: 22127 - protein, 516 aa, Ralstonia eutropha
MKIRAQVAMVLNLDKCIGCHTCSVTCKNVWTSRDGVEYAWFNNVETKPGIGYPKEWENQDKWQGGWKRNADGTLEPRQGGKLKILANLFANPNLPAIDEYYEPFTYDYEHLQKAPLVQTPPTARPVSVLTGRKMEKIEWGPNWEDDLGGEFSSRGRDKLFDNVQKEMYSTFENTFMMYLPRLCEHCLNPACVASCPSGSIYKREDDGIVLVDQDKCRGWRMCISGCPYKKIYFNWQSGKAEKCLFCYPRIEAGQPTVCSETCVGRIRYLGVMLYDADRIEQAASVADERDLYQSQLDVFLDPHDPAVQAEALRQGIPQSWLDAARKSPVYKMACEWKVAFPLHPEYRTLPMVWYIPPLSPIQSAAEAGHMGLNGVIPDVKSLRIPVRYLANLLTAGDVMPVLSALDRMLAMRAYKRSQVVDGVQDLGVLEQVGLTPAQVEDMYQTMAIANYEDRFVIPSSHKEMVEDSFNDKASCGFTFGNGCSGGTSEGALFGKKPQGSVHFVDMPKSRKKAVMS

SEQ ID NO: 22128 - protein, 114 aa, Klebsiella pneumoniae
SLYDIAPVTPGVAVDLSHIPTDVKIKGFSGEDATPALEGADVVLISAGVARKPGMDRSDLFNVNAGIVKNLVQQIAKTRPQACIGIITNPVNTTVAIAAEVLKKAGVYDKNKLF

SEQ ID NO: 22129 - protein, 251 aa, Zea mays
MKSYPWAGARPLAVVQLLLFLADNMSGKSTLSEVRTSSGTFLRKGQDPIVESIEDKIAAWTFLPKENGEDIQVLRYKHGEKYEPHYDYFTDNDNTVRGGGHRYATVLLYLTDVPEGGETKKKKKKKKKVFPLAEEPDDAKDATLSECAQKGIAVRPRKGDALLFFNLNPDGTTDSVSLHGGCPVIKGEKWSATKWIRVASFDKVHHPQGNCTDENESCAKWAALGECIKNPEYMVGTTALPGYCRRSCNVC

SEQ ID NO: 22130 - protein, 391 aa, Thermosynechococcus elongatus BP-1
MNLLEQLRQMTVVVADTGDILAIQKFTPRDATTNPSLITAAAQMKEYQSIVDETLRQAKADLGSGATSREIVSLAVDRLAVAFGLKILQIIPGRVSTEVDARLSYDTAATVQKARELISQYEAAGVGRDRVLIKIAATWEGIRAAEILEKEGIHCNLTLLFGFHQAVACAEAGVTLISPFVGRILDWYKKKTGRAEYPGPEDPGVISVTKIYNYYKKFGYPTEVMGASFRNIGEIIELAGCDLLTISPALLQELQNTTGELKRKLDPAIAATLDIEKVAMDEATFRKMHAADEMASEKLEEGIKGFTKALETLEDLLRRHLARIEGEATLTHAAEELFHVYDLDGDGIITREEWLGTDAVFDALDANHDGKVTPEDMGAGLGVVLHLAQAK

SEQ ID NO: 22131 - protein, 364 aa, Zea mays
MALAGITNQDLLDAQVELWHSTFAYIKSMALKSALDLGLADAIYHHGGSATLPQIVDRVTLHPSKTLHLRRLMRVLATTGVFSVQHPSPLGDDSSSASDSEPVYKLTAVSALLVGPRRSHVPLAAFVVDPALVTPFFELGKWLQRELPGPCIFEHAHGQTIWEHANGDAAFNALLNDGMLSDSHFIMDIASKECADVFQGISSLVDVGGGLGAAAQAISLAFPGVKCSVLDLDHVVAKAPSDTQVSYIGGDMFESVPPADAMFLKWVLHDWGHEECVKILRNCRKAIPPREGGGKVIIIDMVVGAGPADPRHREMQALFDLYIMVVNGMERDEQEWKRIFVEAGFTDYRVTPVLGVRSIIEVYP

SEQ ID NO: 22132 - protein, 253 aa, Glycine max
MVSNSAFEDNGTDNNHNSNNKYTSIKAKFMDSELKSSPLKSWVNNNKNSEGEFSKSSNKRGKFECTTCKKIFHSYQALGGHRASHKRIKGCFASRNESSENSTELEAELSPDPTTESKLLKNEYVEEHEMVTNVTTATTTTQFDNEVETVRDSKKGKGHECPICHKVFPSGQALGGHKRSHHLAGGSESARNFQSQTIVLEEAAPEIRDFFDLNLPASTEEEGTGHRHAEHYKPWWVVGGNHKQEALVGLISN

SEQ ID NO: 22133 - protein, 363 aa, Buchnera aphidicola (Pemphigus spyrothecae)
MTKIYNLAILPGDGIGPELLQKDLNFKVLKEQYKLKINTTEYDIGGIAIDKYGKALPKETLDGCKESDSILFGSVGGPKWQHLPPDQQPERAALLPIRKYFNLFSNLRPAKLYSTLNHLSPLRRDISEKGFDILCVRELTGGIYFGKPKGYIKNIIDKKAFDTEIYYASEIKRIAHIGFKLAQNRKYKITSVDKANVLESSVLWRETVNTISKEYPDVKLSHLYIDHAAMQIIKNPDKFDVILTSNLFGDILSDECAMITGSIGMLPSASLNDSNFGLYEPAGGSAPDIAGKNIANPIAQILSIAMLVRYTMKLPMISDHIESAVIDTLKKGYRTLDIANDKEKYVSTNDIGDIISDILKKRI

SEQ ID NO: 22134 - protein, 508 aa, Campylobacter jejuni subsp. jejuni NCTC 11168
MQKDNLIAFVIFIISTIAFVIWGFGYISQHQLILFILASIFGIFMAFNIGGNDVANSFGTSVGAKTVTIKQALIIAAVFELSGAIFAGAEVTKTIRSGIVIFPNSLDPMLFVIIMLAALLSSGVWIFIATKKGLPVSTTHSIVGGIVGASIMMGLLKFDGIQTLSMVKWSEILRIAISWIASPLLGGIVAYIIYSYIDKKILKPSEKLNDDLKNIKKERKKFKEEYFLNLKTKSQEEQIKELSAIALDEEEQENNFYRNKMKEFKDQEKDIDIYSILKTHMPIIACIAAAIISAMFLFKGLNNVSTLDILQNFWIIGIIGTISYVVTFAIVKIVKKTELNKTTDRIFSWFQIFTASSFAFSHGANDIANAIGPFAAILDVLKNGTINATSPVPFAALAMFGVALVVGLWFLGKEVITTVGSKLATIRPTTGFSAELGASIVILLATQFGIPVSSTHILIGAILGIGVYNKNANWIMMKPIGLAWIITLPAAGIMAALVFLGFKLSLGI

SEQ ID NO: 22135 - protein, 298 aa, Triticum aestivum
MKIFVDTDADIRLARRIRRDTVERGRDVLSVLEQYGRFVKPAFDDFILPSKKYADVIIPRGGDNHVAIDLIAQHIRTKLGQHDLCKLYPNVCVVQTTFQIRGMHTLIRDREITTPDFVFYSDRLIRLVVEHGLGNLPFTEKQVVTPTGSVYSGVDFCKKLCGVSIVRSGESMENALRACCKGIKIGKILIHRVGDDGQQLIYNKLPSDIAERHVLLMDPVLGTGNSANQAIQLLRSTGVPEDHIMFLNLISAPEGIHCVCKRFPDVKIVTSEIDAGLNQDYRVVPGLGEYGDRYFGTD

SEQ ID NO: 22136 - protein, 451 aa, Zea mays
  unsure (1)..(451): unsure at all Xaa locations
MATHAALAASRIPAGARLHSRAAASSRHGVQRLDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKXITVVSSRDPLKLPWGELGIDIVIEGTGVFVDGPXGAGKHIQAGAKKVIITAPAKGXADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 22137 - protein, 131 aa, Salmonella enterica
HCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEAMDKNLYDL

SEQ ID NO: 22138 - protein, 504 aa, Xylella fastidiosa 9a5c
MLTRKKSMDCKVGRLGMPIALAVSDCYPNPKRFPLMSLENVEKLVKDKKIEFVDLRFVDMRGVQQHVTFPVNILEPSLFKDGKMFDGSSIAGWKGINESDMVLLPDANTAYLDPFYADPTLVMTCDILDPATMQSYVRDPRGIAKRAEIYLNSLGIADQAFFGPEPEFFIFDSVRFANDMGHAFFQIASEEAAWNTGAEFEGGNGGYRPAVKGGYFPVPPTDSLHDLRAEMVKTLEQVGIETEVHHHEVATAGQCEIGTKFNSLVKKADQLMTMKYILKNVAYRNGKTVTFMPKPMVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFIDGYIALKMQEVTQFRAATHPLEYQMYYAN

SEQ ID NO: 22139 - protein, 84 aa, Kandelia candel
MDLRVMGLDSPLFSTLQHMIDAGNEEAEKSSHGPTRVYMRDAKAMAATPADVKELPNAYVFVIDMPGLKSGDIKVQVEEDNVLI

SEQ ID NO: 22140 - protein, 197 aa, Solanum tuberosum
MRVISKLTLLIISIGCIFQVSSLGADASSLLPLILDQMIGSNPANTFLDPFKVLEQIPFGLENREETTLPLSIARVDWKETAEGHVISIDVPGLKKDDIKIEIEENRVLRVSGERKKEEEKNDEQNHWHCVERSYGKFWRQFRLPENADIDTMKAKLENGVLTISFAKLSADRIKGPKVVSIESKQEGKESSVREEL

SEQ ID NO: 22141 - protein, 196 aa, Mitthyridium sp. Wall 1086
GGAKKVVISAPSKDAPMFVMGVNEEKYTNEDIVSNASCTTNCLAPLAKVINDKFGILEGLMTTVHATTATQKTVDGPSNKDWRGGRSAGTNIIPSATGAAKAVGKVLPELNGKLTGMAFRVPTTDVSVVDLTVRLEKPASYDAIKAALKEASQGKMKGILGYTEDDVVSSDFITDSQSSIFDAKAGIALSDRFVKL

SEQ ID NO: 22142 - protein, 248 aa, Schizosaccharomyces pombe
MSRSYDSRTTIFSPEGRLYQVEYALEAINHAGVALGIVAKDGIVLAAEKKVTSKLLEQEESAEKLYHIGDNMLCAVAGLTADANILINYARRVGQQYLQTFNEEMPCEQLVRRVCDLKQGYTQYGGLRPFGVSFLYAGWDHIRGYQLFQSNPSGNYGSWQANSIGGNSTSVQSLMRQEYKDDINLDEASAMAVKFLSKTLDSNSLTHEKIEFATITKDTTKNKMVCKIWKSDEINEVLNKYQETQRQS

SEQ ID NO: 22143 - protein, 280 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 22144 - protein, 468 aa, Saccorhiza polyschides
IPYAKMGYWDADYNVKHTDILALFRITPQPGVDPVEAAAAVAGESSTATWTVVWTDLLTACDIYRAKAYRVDPVPGTNDQYFAYIAYECDLFEEGSLANLTASIIGNVFGFKAVAALRLEDMRIPYAYLKTFQGPATGVVVERERLDKFGRPLLGATVKPKLGLSGKNYGRVVYEGLTGGLDFLKDDENINSQPFMRWKERFLYCMEGVNRSAAATGEVKGSYLNVTAATMEQMYERAEYSHAIGSVICMIDLVVGYTAIQTMAIWARKAEMILHLHRAGNSTYARQKNHGINFRVICKWMRMCGVDHIHAGTVVGKLEGDPLMVKGFYNTLLLTQLKINLAEGLFFDMDWASLRKCVPVASGGIHCGQMHQLLYYLGDDVVLQFGGGTIGHPDGIQSGATANRVALEAMVLARNEGRDYVGEGPQILRNAASTCGPLKAALDLWKDITFEYTSTDTPDFVEVATESN

SEQ ID NO: 22145 - protein, 133 aa, Oryza sativa
  unsure (1)..(133): unsure at all Xaa locations
CLAVTTAASCGHFAVATYLLAHIPRHVLEALSPQILKAARGQGSGSFEGVSFLLRSNFLNDAAATYAVADSIATTSTMDIPQDLVDFLKEQWSQAAFXEGVEAGEDHFVNITRVLRRGASPIRLXDLPEPMAL

SEQ ID NO: 22146 - protein, 503 aa, Methanobrevibacter arboriphilus
MSNKKKFTTNKGIPVPNDQASITTGKGSNYTMLGDSHLTEKLAHFGRERIPERVVHAKGTGAYGYFEVTNDLSKYTRAKFLSEVGKKTEVFIRFSTVGGERGSADAKRDPRGTAMKYYTEEGNYDLVGNNTPIFFIRDAIKFPDFIHTQKRNPKNNLSDADMFWDFMSLTPESIHQATFLFTDRGTPQNYRHMDLFGSHSFMWYNEKNEYVWVKYHFKTAQGIQNLTNDEAIKMCGENPDHATEDLFNAIEEGNYPEWNVYVQIMTPEEAEKYEFDPFDVTKVWFHGDYPLIPLGKLVLNKNPENFFAEVEQVAFAPSNFVPGIGPSPDRLLQGRLFSYEDTQRHRLGPNHHQIPINRAKNAEVNTYQRDGPMTVTDNGGSGPNYYPNSFDGPEVDETVTPPTIELKAEINRHPRPVEDVDFFQTGELWRRVLSDEDKDHLVYNIVAHLGNAQERIQYRQCALFYKAEPEYGTRVAEGIGLDISKVKNLSEMTQEERVEATKK

SEQ ID NO: 22147 - protein, 476 aa, Aquifex aeolicus VF5
MIEKKMLIGGEWVDKEEKIEVIYPYTRKPIGRVPKGDEKDVEKAIERAKEGFKEIFSLTAYERYEILMRAAQLLKERAEEFAKTLVLEVGKTIREARTEVQRAIQTLIFSAEEAKRVNGETFPIDAHPNGKGKLGFYIRVPVGIVSAITPFNFPLNLSMHKVAPALAAGNAVILKPSERTPLTPLMLGEILLEAGVPPKALSVIPGYGDVGKAMTTHPDVRVVSFTGSRKVGDIIARQVGIKKLVLELGSNSAIILHKDGNLEKAVEKTVQGGYAIAGQVCISVQRVFVHEDLYDEFIKRLKERVSKLKVGDPMNEDTDLGPMIAPSELERIQEWISEAVQKGAKIEAGGLRCAEDETIFSPTIVSLVPEDSKLFKEEAFAPVVAVNPYKDIEEAIRWVNSSDYGLQVGVFTNDVKLAWKCIKEIEAGGVLINEGPTFRADHMPYGGVKYSGIGREGPKFAIEDYTEIKTVIFDLT

SEQ ID NO: 22148 - protein, 486 aa, Ralstonia eutropha
MNAPESVQAKPRKRYDAGVMKYKEMGYWDGDYEPKDTDLLALFRITPQDGVDPVEAAAAVAGESSTATWTVVWTDRLTACDMYRAKAYRVDPVPNNPEQFFCYVAYDLSLFEEGSIANLTASIIGNVFSFKPIKAARLEDMRFPVAYVKTFAGPSTGIIVERERLDKFGRPLLGATTKPKLGLSGRNYGRVVYEGLKRGLDFMKDDENINSQPFMHWRDRFLFVMDAVNKASAATGEVKGSYLNVTAGTMEEMYRRAEFAKSLGSVVIMIDLIVGWTCIQSMSNWCRQNDMILHLHRAGHGTYTRQKNHGVSFRVIAKWLRLAGVDHMHTGTAVGKLEGDPLTVQGYYNVCRDAYTHTDLTRGLFFDQDWASLRKVMPVASGGIHAGQMHQLIHLFGDDVVLQFGGGTIGHPQGIQAGATANRVALEAMVLARNEGRDILNEGPEILRDAARWCGPLRAALDTWGDISFNYTPTDTSDFAPTASVA

SEQ ID NO: 22149 - protein, 336 aa, Porphyra yezoensis
MVVKIGINGGGRIGRLVLRAALEKGGVEVVAINDPFIALDYMAYMFKYDSTHGPYKGKVEVVDGKLVIDGFTITMFGMRDPAEIPWKDVGAEYIVESTGVFTTTDKAKAHLVGGAKKVVISAPSADAPMFVCGVNEKKYTPDLSIVSNASCTTNCLAPLAKVLHEKYGILEGLMTTVHATTATQKTVDGPSHKDWRGGRGAGANVIPSSTGAAKAVGKVIPELNGKLTGMAFRVPTPDVSVVDLTVRLQKPTTYDDIKATMKAASEDDLAGILGYTEDAVVSTDFVHDNRSSIFDASAGIMLNETFVKLVAWYDNEWGYSNRVVDLITHMSKVDSA

SEQ ID NO: 22150 - protein, 543 aa, Oryza sativa
MEVTSTPAMLLYAALFAAALLYLAVAVRRGRGAGLPPGPTGLPLVGSLLSLDPELHTYFAGLAARYGPIFSIRLGSKLGVVVTSPALAREVLRDHDLVFSNRDTPDAACSISYGGGQNIVWNPVGPTWRLLRRICVHEMIGPAGLDSLHGLRRREFMATLHHLRARSGEPVNVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMCSLLSHCTAGVGDDDTTIHGCVIWLQDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPERFLPADGGGGRRLDFTGSEQEYMPFGSGRRICAGVAMAERMVAYSLAMLVQAFDWELPAGERLDLAERFGIVMKKATPLVAVPTPRLSNPQLYSA

SEQ ID NO: 22151 - protein, 157 aa, Zea mays
  unsure (1)..(157): unsure at all Xaa locations
MAAAAAAPASVAPSPAPKAXGDSRKTVVPVDASELEKHVLAVDDSSVDRAVIARILRGSRYKVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 22152 - protein, 478 aa, Arthrobacter sp. BP2
MVPAAGLDYYVIHHRGEPPMGVYTTIDPATGDATAQYPEISDAELDTLIKNSAAAYRSWRTTTLEQRRAVLTRTAEIHREQAEELAKLLTLEMGKPIAQARGEVELVASIYQHYADNLEEYLADESLTFRGSGTAVVRTEPIGPLVGVMPWNYPYYQVARFAAPNIALGNTIILKHARNCPQSALAIERVLTEAGLPAGVYANAFISSAQVAAAVADRRVQGVSLTGSEKAGAAVGEVAGRNLKKCVLELGGSDPFIVLDDADIDAAAAAAVIGRLSNGGQACTASKRFIVADSVYEEFLQKFLDAMASWQTGDPTDSGTKLGPLASAAGVEELDELVQDAVSHGAKLLLGGERPDGPGAYYPATVLAGVTPAMRAFTEELFGPVAVVYRVGSLQEAIDLANNSPFGLSSSVFTSDARNAERLAEELEVGMVWINSTSKSSPDLPFGGVKGSGFGRELAGYGFNEFANKKLVRNPGAR

SEQ ID NO: 22153 - protein, 267 aa, Triticum aestivum
MGKIKIGINGFGRIGRLVARVALQSDDVELVAVNDPFITTEYMTYMFKYDTVHGQWKHSDIKIKDSKTLLLGEKPVTVFGIRNPDEIPWAEAGAEYVVESTGVFTDKEKAAAHLKGGAKKVVISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSA

SEQ ID NO: 22154 - protein, 421 aa, Nostoc punctiforme
MVSVSDAQAIILDLVQPLDLQRDTEVVDLLAADSRILAVPVTSPLDFPHWDNSAMDGYAVRYEDVQHSSAEQPAVLEIVEDIPAGYQPKSRIQSGEAARIFTGAVIPAGADTVVMQERTRREENRVFILAAPQPQEFVRHKASFYQAGTQLLPAGIKLNASEIAVLAAAQCPQLNVYRRPRVAIFSTGDELVTVDQPLQPGQIVDSNQYALAALVKESGAEPILLGIVKDDPVTLERVIAHAVAIADIVLSSGGVSVGDYDYVDKIIESLRAKIHIRSVEMRPGKPLTVATFPSTDAINRVSPHSALYFGLPGNPAAVLVTFWRFVLPAIKKLSGITEGWEPVFLKVRSHDELRSDGKRETYLWGKLHLINGVYEFHKAGGSHSSGNLINLAQTNALAVLPMGKTSIYPQEEVQVLQLSNG

SEQ ID NO: 22155 - protein, 159 aa, Triticum aestivum
MAGMVFGLDAPMMAALQHLLDIPDGEAGAAAGEKQGPTRAYVRDARAMAATPADVKELPGAYAFVVDMPGLGSGDIKVQVEDERVLVISGERRREEKEDAKYLRMERRMGKLMRKFVLPENADMEKISAACRDGVLTVTVDKLPPPEPKKPKTIQVQVA

SEQ ID NO: 22156 - protein, 301 aa, Shigella flexneri 2a str. 301
MDEIMTNLKAVIPVAGLGMHMLPATKAIPKEMLPIVDKPMIQYIVDEIVAAGIKEILLVTHASKNAVENHFDTSYELESLLEQRVKRQLLAEVQSICPPGVIIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 22157 - protein, 506 aa, Oleomonas sagaranensis
MIHQTIEEISKSIAFRSRYDNFIGGKWVAPVRGQYFDNITPITGMPVAQIARSTAEDIELALDAAHAAKDAWGRTSVAERARLLNKIADRMEEKLDLLAMVETIDNGKPIRETKAADLPLAIDHFRYFASCVRAQEGSIGEVDHDTMAYHFHEPLGVVGHIIPWNFPLLMACWKLAPALAAGNCVVLKPAEQTPLSIMVWADLIGDILPPGVLNIVNGFGIEAGKPLASNKRIAKIAFTGETTTGRLIMQYASENLIPVTLELGGKSPNIFHEDVAAEDDDYFDKAIEGFVLFALNQGEVCTCPSRAIIHEKIYDKFMERALARVAAIKQGSPLEAATMLGAQASNDQLEKILSYIDIGKAEGAELLIGGERNILGGELAGGYYVKPTVFRGNNKMRIFQEEIFGPVVSVTTFKDEAEALSIANDTLYGLGAGVWTRDGNRAYRFGRAIQAGRVWTNCYHLYPAHAAFGGYKQSGIGRETHKMMLDHYQQTKNLLVSYSPKALGFF

SEQ ID NO: 22158 - protein, 241 aa, Bidens pilosa
EREGVTDVFAYPGGASMEIHQALTRSNIIRNVLPRHEQGGVFAAEGYARATGRVGVCIATSGPGATNLVSGLADALLDSVPLVAITGQVPRRMIGTDAFQETPIVEVTRSITKHNYLVLDVEDIPRIVKEAFFLANSGRPGPVLIDIPKDIQQQLVVPNWEQPIKLGGYLSRLPKPTYSANEEGLLDQIVRLVGESKRPVLYTGGGCLNSSEELRKFVELTGIPVASTLMGLGAFPYTDDL

SEQ ID NO: 22159 - protein, 375 aa, Zea mays
  unsure (1)..(375): unsure at all Xaa locations
MAPTTATKDDSGYGDERRRELQAFDDTKLGVKGLVDSGVKSIPSIFHHPPXEALSDIISPAPLPPSPPSGAAIPVVDLSVTRREDLVEQVRHAAGTVGFFWLVNHGVAEELMGGMLRGVRQFNEGPVEAKQALYSRDLARNLRFASNFDLFKAAAADWRDTLFCEVAPNPPPREELPEPLRNVMLEYGAAVTKLARFVFELLSESLGMPSDHLYEMECTQNLNVVCQYYPPCPEPHRTVGVKRHTDPGFFTILLQDGMGGLQVRLGNNGQSGGCWVDIAPRPGALMVNIGDLLQLVTNDRFRSVEHRVPANKSSDTARVSVASFFNTDVRRSERMYGPIPDPSKPPLYRSVRARDFIAKFNTIGLDGRALDHFRL

SEQ ID NO: 22160 - protein, 242 aa, Zea diploperennis
SIRNNPVQNKLMNGEDPINNNHAQTAGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKGVIEMSSSVLLSMPISAPTPSSDAPVPPPPPIRDSIVGYFSAPAAEDDASVGNGFLRLQAQEPASMVVGGTLSATEMNRVAAATHCAGAMELIQTAMG

SEQ ID NO: 22161 - protein, 372 aa, Candida albicans
MKKFTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQGYMPSDLHNLIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQDALEHPYLNSYHEQLDEPVTSPIPIEEFDFDIDKKNLDTNDLKKQIFEIVMS

SEQ ID NO: 22162 - protein, 353 aa, Oryza sativa
MSCSYVKDYEFVAIFDADFQPNPDFLKRTVPHFKDNDELGLVQARWSFVNKDENLLTRLQNINLCFHFEVEQQVNGIFLNFFGFNGTAGVWRIKALDDSGGWMERTTVEDMDIAVRAHLRGWKFIFLNDVECQCELPESYEAYRKQQHRWHSGPMQLFRLCLPDIIKCKQIVFWKKANLIFLFFLLRKLILPFYSFTLFCIILPMTMFVPEAELPDWVVCYIPALMSLLNILPSPKSFPFIIPYLLFENTMSVTKFNAMISGLFQLGNAYEWVVTKKSGRSSEGDLISQSAPRKDVKKKHNRIYKKELALSLLLLTAAARSLLSKQGIHFYFLLFQGISFLLVGLDLIGEQIE

SEQ ID NO: 22163 - protein, 354 aa, Zea mays
  unsure (1)..(354): unsure at all Xaa locations
MDLASFITSVLTSFLIFVALVLLFTWLSRRPGNAPVYYPNLLLRGLDPWAGRGRGTRSPVGWLRDAISASEPDVVAAGGVDAAVYLVFLSSVLSILVYSGIVLLPVLLPVAATGGALSTIPIPTNKSAQSAQNFSSIERLGMGNVAEKSMRLWAFLLSVYWVSFVTYFVLWKSYKHVSNLRATARSAPDVKPEXFAVLVRDIPRPSPDETIKDSVDSYFRALHPNTFYRSMVVTDHTKADKIYREIEGHKRKIARAEVIYANSKTESNTEGTRPTHRTGFLGLIGTKVDTIEYCSEQIKELLPKLEAEQKTTLHEKQQRAAIVVFNSRSAAAFASQTLHAQVYDKWDSYGKLLN

SEQ ID NO: 22164 - protein, 831 aa, Thermococcus litoralis
METVVNQIKSKLPENLEGLLDLAYNYWWSWNRRATKLWEKIDPEHWWEYKNPVKLLLDTPEERLKELSKDDDFINLYELVIDQFRHYMNPESTWFSTNYPKWEEPVIYLCMEYGISKSLPIYSGGLGILAGDHIKTASDLGIPLIAIGLLYKHGYFKQEIDKDGKQIEVFPEYNPEEMPIKPLTTEKGKPLLIEVPIEDRIVYARAFEVNVGRVKLYLLDTDVPQNSPDDRTICDYLYNAEIDKRIKQEILLGIGGMRLLRMLGIDPAVIHLNEGHPAFANFQRIAWYMEEGLNFLEALTVVRGTTIFTTHTPVPAGHDKFPIAEVEKRLAKFLEGLPKDEFLNLGREGDQFNMTLLSIRTSSYVNAVSKLHSKVTKEMWRHLWNGVPLDEIPVEGITNGVHTKTWLHNEIKKLVDRYIGRVWRDYAELEGLWYGVERIPDEELWEAHLKAKREFIELIKRKIKERNERLGIEEPLPEIDENALIIGFARRFATYKRATLILTDLERLKKIVNNPERPVYIIFGGKAHPRDEAGKEFLRKVYEVSQMPEFKNKIMVFENYDMGSARAMVAGVDVWLNNPRRPLEASGTSGMKAGLNGVLNLSVYDGWWVEGYNGKNGWVIGDESLEPETEKDNIRDAQSLYNLLENEVIPTYYENRARWIYMMKESIKSIAPRFSTHRMVKEYVDKFYSKALANAILLQRDSFKATREIASWKAKIFNSWDKVEIERIITHDATGVEVIVNLDGLSPEDVKVEIYYGVKAEGYAIEKPYVIELKHPQSLGGNRWLYRYEGNALKNLGHPCWHYAVRVYPYHDKLPHKFLLGLIKWKGFFEL

SEQ ID NO: 22165 - protein, 501 aa, Bifidobacterium longum NCC2705
MRLMFEALGPTFVKVGQILSMRSEILPQSFCDELAKLRADADPMPYSTVLDVLAAEYGRPADEVFAHIDPKPLGSASLAQVHRATLKTGEDVAIKVQRPGVRETMAQDVSIMRSIAKAATKVIRTSQIVDLKGVVEELWDTFESETDFLIEARNLAEFKRFAARFKYMDCPTAYTELCTEHVVVMEYIDGISVSHPGRLVDAGYDLKEIGTKLVDNYATQILDDGFFHADPHPGNIIIRGGQIVLIDLGMTGRLDQRTRAVLKEMIFAVAKQDSPALAEGLLRFAGTEADPEDYPALLADLDVIVKEFGTVDLAELDIAAFLTALTQMAGRHNIEVPSTVTTVGRALVTLEGLLDEFIPDVNMIEIISDHIATSKSLKNATKDEIKSLGVEGHQALHATLGTMTELKTVARMLTRGQLRVNMELVGSEEPFQLLSDMVNRLTMALIVVGLFVGSSIVYYAGMKPIIFGIPVIGFMGYVVAFALGVWIVIDIYLKGRKTKKR

SEQ ID NO: 22166 - protein, 198 aa, Streptococcus oralis
GIEDILVVTGKSKRSIEDHFDSNFELEYNLKEKGKTDLLKLVDETTGMRLHFIRQTHPRGLGDAVLQAKAFVGNEPFVVMLGDDLMDITNEKAVPLTKQLMDDYERTHASTIAVMPVPHDEVSAYGVIAPQGEGKDGLYSVETFVEKPAPEDAPSDLAIIGRYLLTPEIFQILENQAPGAGNEIQLTDAIDTLNKTQR

SEQ ID NO: 22167 - protein, 402 aa, Pseudomonas aeruginosa UCBPP-PA14
MNTALDNLQPYPFEKLRALLGGARPPATLKPIALSIGEPKHRSPSFVAETLAENLDQLAVYPTTLGLPALREAIARWCERRFSVPAGWLDAARHVLPVNGTREALFAFTQTVVRRSEPGEAPGLVVSPNPFYQIYEGAALLAGAVPHYLPCREENGFNPDFDAIDEATWQRCQILFLCSPGNPTGALVPLETLKKLIALADRYDFVIAADECYSELYFDENAPPPGLLNACAELGRTDFSRCVVFHSLSKRSNLPGLRSGFVAGDAEILKKFLLYRTYHGCAMPVQTQLASIAAWNDEVHVRANRSLYREKFDAVLAILDGVLDVQRPDGSFYLWARTPVDDTVFTRELFEQQHVTVVPGSYLSREVDGENPGANRVRMALVAPLAECVEAAERIRDYLRAR

SEQ ID NO: 22168 - protein, 343 aa, Bacillus subtilis subsp. subtilis str. 168
MFNNQMLGVIDETTYKHSLQDLTAQRSLGAIPFAGRYRLIDFMLSNMVNADIRSVAIFPKYRYRSLMDHLGAGKEWDLHRKKDGLFFFPSPHLHHEYDEFGSFRQFSDHLDYFHRSTQQYAVISNSHTVCNIQFQYVLKRHQEVGCDVTEVFQDGQSLQIYIMSTTLLKDLIYGHSEKGYKTIQEAVEKESSALTICPYEYSGYAAVIDSVEKYYTHSMELIQPRFWQQVFLPQQPIYTKVKDEPPTKYGKHSTVKNSLVANGCVLEGEVENCILFRAVHVGKGTKLKNCIIMQKTQIGEDCLLEQVISDKDVKIGKATEAAGTAEQPLVLRKGLVQGELMNS

SEQ ID NO: 22169 - protein, 185 aa, Vibrio vulnificus CMCP6
MLLIIDNYDSFTYNLYQYFCELGAQVQVVRNDEIDLAGIAQLNPTHLVISPGPCTPNEAGISLAAIEHFAGKLPILGVCLGHQAIAQVFGAKVVRARQVMHGKTSPITHNGRSVFKGLNNPLTVTRYHSLGWKMARYQRVLSSPHGQLMPMAAWTKSWAISTKHWRLMRFSFTQSRSKLSKDISY

SEQ ID NO: 22170 - protein, 237 aa, Brassica rapa
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVAINGNGVSQSGKIHTCSICFKSFSSGQALGGHKRCHYDAGINGNGNGSSSNSVEVVGGSDGNYVDDERSSEQSATGDNRGFDLNLPADQVAVVISKR

SEQ ID NO: 22171 - protein, 621 aa, Mycobacterium avium
MSAPTRRPAPDAPGAAGIAPAPPAPAAKPAAGKPKRIGPEQVTGAQSVIRSLEELGVEVIFGIPGGAVLPVYDPLFDSKKLRHVLVRHEQGAGHAASGYAHATGKVGVCMATSGPGATNLVTALADAQMDSIPVVAVTGQVGRTLIGTDAFQEADISGITMPITKHNFLVVRQRNPAVLAEAFHIAASGRPARCSVDIPKDVLQGQCTFSWPPRIHLPGYKPTTKPHSRQIRERAKLIAAARKPVLYVGGGVIRGEASEQLRELAELTGIPVVTTLMARGAFPDSHRQHLGMPGMHGTVAAVAALQRSDLLIALGTRFDDRVTGKLDTFAPEAKVIHADIDPAEIGKNRHADVPIVGDVKAVIAELVEILRHDGAPGNLDIADWWAYLDDVQSTYPLSYGPQSDGSLGPEYVIEKLGQIAGPDALYVAGVGHDQMWAAQFISYEKPRTWLNSGGQGTMGFAIPAAMGAKMGRPEAEVWAIDGDGCFQMTNQELATCAVEGIPIKVALINNGNLGMVRQWQTLFYEERYSQTDLGHPLAPHPDFVKLAEALGCVGLRCEREEDVVDVINAARAINDRPVVIAFIVGADAQVWPMVAAGTSNDEIQAARGIRPLFDDETEGTP

SEQ ID NO: 22172 - protein, 462 aa, Streptomyces avermitilis MA-4680
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 22173 - protein, 336 aa, Nicotiana tabacum
KLKVAINGFGRIGRNFLRCWHGRKDSPLDVIAINDTGGVKQASHLLKYDSTLGIFDADVKPVGTDGISVDGKVIQVVSDRNPVNLPWGDLGIDLVIEGTGVFVDREGAGKHIQAGAKKVLITAPGKGDIPTYVVGVNADLYNPDEPIISNASCTTNCLAPFVKVLDQKFGIIKGTMTTTHSYTGDQRLLDASHRDLRRARAAALNIVPTSTGAAKAVALSSQALRGSSMALPLRVPTPNVSVVDLVVQVSKKTFAEEVNAAFREAADKELKGILDVCDEPLVSVDFRCSDVSSTVDASLTMVMGDDMVKVIAWYDNEWGYSQRVVDLADIVANQWK

SEQ ID NO: 22174 - protein, 162 aa, Glycine max
MAREQIQVLNALDVAKTQWLLGRIYYHVDGAAKPGTLPPNVSAAVNDYPLSATIMSEYSNKKTRGAFIAAVFAMQGFGILAGGIFAIIISVAFKERFDAPPYELDPAGSTVPQADYIWRIIVMVGALPAALTYYWRMKMPETARYTALVAKNTKQAAADMSK

SEQ ID NO: 22175 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKLLRKWYDLLMVHKEELAQLITLEQGKPLKESVGEIVYGAGFIEFAAEEAKRIYGDIVPAPFSDRRLFVLKQPVGVVGAITPWNFPLAMITRKVGPALACGCTVVIKPSELTPLTALAAVELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDAVQNMKVGDGFSEGVSQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 22176 - protein, 222 aa, Bifidobacterium longum NCC2705
MSNIAIAPSILSADFCNLERDLKAIANADLVHVDVMDHHFVPNLTLGEPIVGRICQVTDLPVDVHLMIEDPDRWAPEYAKLGAASVSFHMGATHAPVRLARQLREMGCKACFAVRPAEPVEPIFDILDEFDMVLIMTVEPGFGGQKFLDNQMSKVRRLRDEITRRGLKTRIQVDGGVSPKTAHIVAEAGADVLVAGSAVYGAENPAQAIDDIRTKAEAAFKA

SEQ ID NO: 22177 - protein, 121 aa, Triticum aestivum
MHLRQQQQQHHRAEMVAPKGCVTVRVGAEGEEQRRFAVPLDHLKHPLFGALLDEAEREYGFRHQGAIAIPCRVDRFVHVERLIDRDLGAHGHQLVDLDCGAATAHGHGHLHLPRFVGCFRA

SEQ ID NO: 22178 - protein, 472 aa, Navicula salinicola
DRYESGVIPYAKMGYWDASYSVKTTDVLALFRITPQPGVDPVEAAAAVAGESSTATWTVVWTDLLTACDRYRAKAYRVDPVPNTQDQYFAFIAYECDLFEEGSLSNLTASIIGNVFGFKAVAALRLEDMRIPHSYLKTFQGPATGIIVERERLNKYGVPLLGATVKPKLGLSGKNYGRVVFEGLKGGLDFLKDDENINSQPFMRWRERFLNCMEGIKRAAAATGEIKGSYLNVTAATMEEVHKRAEYAKSVGSVIIMIDLVMGYTAIQSIALWARENDMLLHLHRAGNSTYARQKNHGINFRVICKWMRMSGVDHIHAGTVVGKLEGDPLMIKGFYDTLRLTNLDVNLPYGIFFEMTWASLRRCMRVASGGIHCGQMHQLVHYLGDDVVLQFGGGTIGHPDGIQAGATANRVALEAMVLARNEGDDYFNQQVGPQILREAAKTCGPLQTALYLWKDISFNYTSTDTADFAET

SEQ ID NO: 22179 - protein, 405 aa, Thermobifida fusca
MVGLFDPTRYPGTGRAGNRPTSGTPSVGPETEERQVSDSTVREEPELIQLLTPDGEYVPHPDYPFEPATAQVRDLYRDLVLVRRLDAEAVALQRQGELGLWASLLGQEAAQIGSARALEPQDMAFPSYREHGVAWCRGVRPRDLLAMFRGVTNGGWDPYEHNFHLYTIVIGSQTLHATGYAMGVQRDGALGEDGTAVITYFGDGATSQGDTNEAFNYAAVNNAPVVFFCQNNQWAISEPNDRQSKAPIYQRAAGFGFPGIRVDGNDVFACLAVTRKALQHAREGQGPTLIEAFTYRMGAHTTSDDPTRYRTSAEIEEWRRKDPIARLRAYLVREGKADDGFFDAVEAEAEKLGEQVRAECRALPDPAPLDIFREVYAEPHRELDRQRAEFADYLASFEGAEGAAR

SEQ ID NO: 22180 - protein, 375 aa, Arabidopsis lyrata
MALSLQSPPCATLSASIQKGRWKTLAAGFSATPLPAVNFSIRRSIPRILASASSSSSPSSSSLEAGENNELNAVSAFSEIVPDTVVFDDFERFPPTAATVSSSLLLGICGLPDTIFRNAVDMALADSSCAGLETTESRLSCFFNKAIVNVGGDLVKLVPGRVSTEVDARLAYDTNGIIRKVHDLLRLYNEIDVPHDRLLFKIPATWQGIEAARLLESEGIQTHMTFVYSFAQAAAAAQAGASVIQIFVGRLRDWARNHSGDTEIESAIKSGEDPGLALVKRSYNYIHKYGYKSKLMAAAVRNKQDLFSLLGVDYVIAPLKVLQSLKDSPAIPGDEKYSFVRKLTPETATHYHFTNKELIKWDQLSLASAMGPASV

SEQ ID NO: 22181 - protein, 493 aa, Magnetospirillum magnetotacticum
MEGLKLVTPAFDDYVLPITVAIIVGLFAVQSHGTARVATFFGPAMVVWFLSMAAALPHIAGNPGVLAAFNPWYAVHYLLGHGTGALVALGAVFLAVTGAEALFADLGHFGRRPIQVAWLGLVAPSLVLNYLGQTALVLAKPETTDPFYQLVPEWGLIPMVLLATLATVTASQAVITGAFSLSRQAIQLGMLPRMEIRHTSEAHSGQIYLPQINTLLGLGVVVLAVTFRSSSALASAYGIAVTGTMLLTASMAYVVLWKVVRLAPLVAAAVLMPFIVLEFLFLLSNLLKIHEGGYVPLMLAGGLMLMMWTWVRGVTILFNKTRKTDVPLIELVGMLEKSTSYQRVKGTAVFLTSDPEIAPAALLHNMKHNKVIHEKNVVLTVETMDRPRVPLAERVRIAPVGFGFYRVVMRFGFMETPNIPRTLALLKREGFKFDIMSTSFFLSRRSIRPAAHSGMPLWQDRIFITLAKNANDATDFFQIPTGRVVEVGTQVTV

SEQ ID NO: 22182 - protein, 157 aa, Zea mays
  unsure (1)..(157): unsure at all Xaa locations
MASDSTAAVTVDGSALAXGRALAAAGTRHMFGVVGIPVTSLASRAAAAGVRFLAFRNEQSAGYAAAAYGFLTGSPGALLTVSGPGCVHGLAGLSHATANAWPLLMISGSCDQADAGRGDFQELDQIAATKPFAKLAVKATTIADIPRLVFQALAAAV

SEQ ID NO: 22183 - protein, 225 aa, Brassica oleracea var. botrytis
MMSSFPLVSFLITLMLAAAVCTHGENRVNDTDGNPLRTTAQYLILPLSPRSNGGGLLPVPVKLQPLCPLGISQSSVKALPGLPVSFSYPYAIMDTYVNEMEAINIEFKSDAWPGCEEFSKYWEVDESSSASEEPAILVGGKKHERNSWFKIERKEPFYGGIAYKLTTLTGTIGTVPGPWENAPQLVLTNDTAKTFLVKFHKVHGDTTATTSTSRQEKLGLRMFPF

SEQ ID NO: 22184 - protein, 486 aa, Pseudomonas putida
MKEIKHFISGELVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENVRRAHRVAGQIEAGIVWVNSWFLRDLRTAFGGSKQSGIGREGGVHSLEFYTELKNICVKL

SEQ ID NO: 22185 - protein, 237 aa, Triticum aestivum
  unsure (1)..(237): unsure at all Xaa locations
FSHFVTNLPAFHQILVFVCVKSVPVPYVPADERYLIGRIGPRQYRMYRCIVRYGYKDVQKDDENFENHLVMSIAKFIQMEAEEAASSGSYESSNEGRMAVIHTTDTTGTGLIMRDSNEGTSLTRSSKSETLQSLQSIYEQESGGLSRRRVRFQIAEEEQINAQVRDELSDLLEAKEAGVAYIIGHSYVKARKNSNFLKSFAIDYAYSFLRKNCRGPXSVTLHIPHISLIEVGMIYYV

SEQ ID NO: 22186 - protein, 474 aa, Triticum aestivum
MAAAAVAADSKIDGLRDAVAKLGEISENEKAGFISLVSRYLSGEAEQIEWSKIQTPTDEVVVPYDTLAPPPEDLDAMKALLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSQRADREGWPGYPPGHGDVFPSLNNSGKLDTLLSQGKEYVFVANSDNLGAIVDIKILNHLITNQNEYCMEVTPKTLADVKGGTLISYEGRVQLLEIAQVPDEHVNEFKSIEKFKIFNTNNLWVNLKAIKRLVDAEALKMEIIPNPKEVDGVKVLQLETAAGAAIRFFEKAIGINVPRSRFLPVKATSDLLLVQSDLYTLVDGYVIRNPARVKPSNPSIELGPEFKKVANFLARFKTIPSIVELDSLKVSGDVSFGSGVVLEGNVTIAAKAGVKLEIPDGAVLENKDINGPEDL

SEQ ID NO: 22187 - protein, 594 aa, Neurospora crassa
MAIFAMGWQKPDNVAGSSAPAIMVGLFVATGGLLLGYDTGTINGILAMKSFKDHFSTGYIDGNGQPGIYPKESALIVAMLSAGTAIGALLAAPLGDHYGRRRSLIGAIGIFVIGAILQVCAYNIDLLVAGRTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPFKISLIMQVINTASTIPGLFVVESWGRRRLLMVGAIGMAICQLLIAAFATASGSNNLSAQNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 22188 - protein, 361 aa, Thermosynechococcus elongatus BP-1
MATTYRIAVLAGDGIGPEITAVALDVLRAIAPRFGLDFDFVPALVGGCAIDAVGEPLPAATLATCRQSDAVLLAAIGGTQWDSLPRHLRPETGLLALRSGLGLFANLRPAKIFPQLLHASSLKPEVIAGVDLMVVRELTGGIYFGQPRGIFTTETGEQRGVNTMAYTATEIDRIGRVAFETARKRQGKLCSVDKANVLEVSQLWRDRLTALSAEYPDVELTHLYVDNAAMQLVRAPKQFDTIVTSNLFGDILSDIAAMLTGSIGMLPSASLGESGPALFEPVHGSAPDIAGQDKANPLAMVLSAAMMLRYGLNQPAAAQAIEEAITAVLDQGYRTGDLMSEGCTLVGCREMGNLLIKELSR

SEQ ID NO: 22189 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 22190 - protein, 595 aa, Neurospora crassa
MGQVSFEGKNPESHYPESRVLIIMTGGTICMQPSADGLVPMTGFLKNAMAPRPSFNDPTAPNVQLRAYKNGAKLTLDSLRTPVSAYSRHIRYGILEFTPLLDSSSISSMGWTEIALTIKENYHMFDGFVVLHGTDSLAYTASALSFMMSDLGKPVILTGSQASIFALQSDAVDNLLGSLIIAGTFVIPEVCLFFHHTLYRGNRTTKVSASSFEAFDSPNCDPLAKVTSLGVDVNWALIRRPTQIAEFQVTKYLDTAHVACLRIFPGIKPEMIESVLKVPDLRGLILETFGMGNAPGGVDGSLTKVIKEAIDRGTVIVNVSQCTNGFVSPLYAPGTVLGRAGVVFGHDLTTEAALTKLSYLLALPNLTYSEITARMSQSLRGEMTEMATPSFSHPAGSIDSAMAWLPAADTAFTALGYAIRNGDLRTVREILEGDEFNHQLLKRADYVGNTPVHLAAVGPNPDVLHELLIRGASVHPRNYANHTPLYLAEKMGNVENVKLLKEAGAHLWRTEPHSGNVSEAGDLASTTDVASVGAADDDKEVKDVSEHRSNEKEQKTNDQVADTVSPRHGLDKSHLVTDESLVHGLKKEDIGKFVN

SEQ ID NO: 22191 - protein, 358 aa, Chlamydomonas reinhardtii
MSSDAMTINESLMEVEHTPAVHKRILDILPGISGGVARVMIGQPFDTIKVRLQVLGQGTALAAKLPPSEVYKDSMDCIRKMVKSEGPLSFYKGTVAPLVGNMVLLGIHFPVFSAVRKQLEGDDHYSNFSHANVLLSGAAAGAAGSLISAPVELVRTKMQMQRRAALAGTVAAGAAASAGAEEFYKGSLDCFKQVMSKHGIKGLYRGFTSTILRDMQGYAWFFLGYEATVNHFLQNAGPGVHTKADLNYLQVMAAGVVAGFGLWGSMFPIDTIKSKLQADSFAKPQYSSTMDCLKKVLASEGQAGLWRGFSAAMYRAIPVNAGIFLAVEGTRQGIKWYEENVEHIYGGVIGPATPTAAQ

SEQ ID NO: 22192 - protein, 270 aa, Prunus persica
CENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQIEVITNGKYKSVMHRVVAQPDGTRMSIASFYNPGDDAFICPATALLEKETENISAYPKFVFDDYMKLYSGLKFQAKE

SEQ ID NO: 22193 - protein, 816 aa, Pseudomonas syringae pv. tomato str. DC3000
MSQEPLVRDADVAAFRAAVLAKLTYSVGKDPDHAFEHDWFEAVALAARDHMVEHWMDHTRQIYRKVQKRVYYLSLEFLIGRLLYDSLSNLGLLEVAREALTELGVDIERIRLLEPDAALGNGGLGRLAACFMESMSTLGIAGHGYGIRYEHGLFRQGIVDGWQQEQTENWLDFGNPWEFERPEVVYSIGFSGSVDTVVTEAGESRQVWRPGETVRAIAYDTPVVGWRGKSVNTLRLWRARAVEDLHLERFNAGDHFGAVAEVVRAESISRVLYPNDATEAGQELRLRQEYFFVSASLQDLLRRHLNQHATLTDLADHAAIQMNDTHPSIAVAELMRQLIDNHNIAWDTAWKITVGTLGYTNHTLLPEALETWSVGLMERMLPRHMQIIYLINAQHIDTLRAKGVDDVNVLRAVSLIEEDNGRRVRMGNLAFLGSHSVNGVSALHTQLMRKTVFAELHKIYPDRINNKTNGITFRRWLFQANPKLTEMLVESLGEDVLDNAETRLKELEPFAEKSSFRKQMADQRLHSKRALAAIIHERLGIAVNPAAMFDVQVKRIHEYKRQLLNLFHTVALYQAIRAEPGTDWVPRVKIFAGKAAASYHSAKLIIKLTNDIARTVNNDPTVRGLLKVVFMPNYNVSLAESIIPAADLSEQISTAGLEASGTSNMKFGLNGALTIGTLDGANVEMSEQVGLEHMFIFGMTSQQVEARKQAGEFSAHADVEASGRLNDVLQAIRGGVFSPDDPNRYVGLIDQLLAYDRFLVCADFDSYWAAQAKVEERWHDSKEWWRSAVLNTARMGWFSSDRTIREYAGDIWKALD

SEQ ID NO: 22194 - protein, 923 aa, Lotus japonicus
MMELPATRILSQAVTCFLCLYIFIGSASATEGFESIACCADLNYTDPLTTLNYTTDYTWFSDKRSCRKIPETELRNRSNENVRLFDIDEGKRCYNLPTIKNGVYLIRGTFPFDSLNSSFNASIGVTQLGAVRSSRLQDLEIEGVFRATKDYIDFCLLKGEVYPFISQLELRPSPEEYLQDFPTSVLKLISRNNLGDTKDDIRFPVDQSDRIWKASSISSSAVPLSSNVSNVDLNANVTPPLTVLQTALTDPERLEFIHTDLETEDYGYRVFLYFLELDRTLQAGQRVFDIYVNSEIKKESFDVLAGGSNYRYDVLDISASGSLNVTLVKASKSEFGPLLNAYEILQVRPWIEETNQTDVGVIQKMREELLLQNSGNRALESWSGDPCILLPWKGIACDGSNGSSVITKLDLSSSNLKGLIPSSIAEMTNLETLNISHNSFDGSVPSFPLSSLLISVDLSYNDLMGKLPESIVKLPHLKSLYFGCNEHMSPEDPANMNSSLINTDYGRCKGKESRFGQVIVIGAITCGSLLITLAFGVLFVCRYRQKLIPWEGFAGKKYPMETNIIFSLPSKDDFFIKSVSIQAFTLEYIEVATERYKTLIGEGGFGSVYRGTLNDGQEVAVKVRSATSTQGTREFDNELNLLSAIQHENLVPLLGYCNESDQQILVYPFMSNGSLQDRLYGEPAKRKILDWPTRLSIALGAARGLAYLHTFPGRSVIHRDIKSSNILLDHSMCAKVADFGFSKYAPQEGDSYVSLEVRGTAGYLDPEYYKTQQLSEKSDVFSFGVVLLEIVSGREPLNIKRPRTEWSLVEWATPYIRGSKVDEIVDPGIKGGYHAEAMWRVVEVALQCLEPFSTYRPSMVAIVRELEDALIIENNASEYMKSIDSLGGSNRYSIVIEKRVLPSTTSTAESTITTQSLSHPQPR

SEQ ID NO: 22195 - protein, 179 aa, Pseudomonas syringae pv. tomato str. DC3000
MKAKADTPFVPLNIAVLTVSDTRTRETDTSGQMFVDRLTDAGHGLIERVLLKDDLYKIRAQVATWIADDQVQVVLITGGTGFTGRDSTPEAVACLLDKQVDGFGELFRQISVPDIGTSTIQSRALAGLSNGTLVCCLPGSTNAVRTAWDGILAEQLDSRFRPCNFVPHLKQAEPCATRG

SEQ ID NO: 22196 - protein, 191 aa, Zea mays
TGRGAGVLALAAALPSDAQWLERLPEKKKPLYTPSLPCIEGWGRSLGFPQSREDPPVWVAEKPLWDGGFSLDVPALPIRDLKSGPGNFSKDMERRFSSALSREDIGNAILGGPLAEPMAKGVRARHWLVGVGPEEIIPPPPRGVPLSQCKSQWVMCREIIFMGHILGKKKKKKKKKKKKKKKKLKTKQTPP

SEQ ID NO: 22197 - protein, 566 aa, ASPERGILLUS NIDULANS FGSC A4
MATKDLPTHLSSNTGFGKHHGKTQSHMVSSVLCLCVDSFSGFRGAWKAPPAMTDASGYAICSQDVMSQTALQLCSLGTQAFENASTSVAASQMRNALNALAETVPDPNERKRFEAEMDNFFALFRRFLNDKAKGNVVNWDRIAPPQPSQVVNYDDIGKESSVEFLNKLAVVKLNGGLGTSMGCVGPKSVIEVREGMSFLDLSVRQIEHLNRTYNVNVPFVLMNSFNTDQDTQSIIKKYQGHNVDIITFNQSRYPRIIKDSLLPAPKSFDAPLQDWYPPGHGDVFESLYNSGTLDKLLERGVEYIFLSNADNLGAVVDTRILQHMIDTKAEYIMELTDKTKADVKGGTIIDYEGKVRLLEIAQVPKEHVNEFKSIKKFKYFNTNNIWMNLRAIKRVVEENELEMEIIANEKSIPADKKGEADQAIYQLETAVGAAIRHFKNAHGVNVPRRRFLPVKTCSDLLLVKSDLYRLEHGQLVMDPNRFGGVPVIKLGSDFKKVSDFQKRIPSIPRIVELDHLTITGAVNLGRNVTLKGTVIIVATEGSTIDIPPGSVLENCVVQGSLRILEH

SEQ ID NO: 22198 - protein, 596 aa, Zea mays
  unsure (1)..(596): unsure at all Xaa locations
MAVGGPSWPNLQCLVRRKPATAGWAEDADRGGVQRLAKTLSIPHLVAIGVGSTIGAGIYVLVGTVAREHTGPGLTLSFLIAGVAAALSALCYAELSCRFPSAGSAYHYSYICIGESVAWLIGWALILEYTIGGSSVARGMSPNLALFFGGQDKLPFFLAQVHVKGLDTPVDPCAAILVLIVTALLCLGIKESSSVEGIITTANIIVMLFVICAGGWLGFRNGWVGYKVPEGYFPNGISGVLSGSATXLFFAFIGFDTVASTAEEVKNPRRDLPLGMGLTLSLCCFLYMMVSAVVVGLVPYHAMDPDTPISSVFARYGMQWAEYVVSSGAVLALVASLIGGILPQPRIIMAMARDGLLPPLFSDVNRKTQVPILSTVLIGTCASVLAFFMDVSQLAGMVSVGTLLAFTAVAISVLVVRYAPPYEMPMEVALAVASFSGHLEHDEQNSEDPFSNVQEALDVSEVAREVRRQKAIGSIVLICVGAIILISAVSVSFLPFYVQRIACTVGGLAVLGSSIVLLCIGQDKKFLGQTGGFMCPLVPFLPVCCIMVNLYLLMNVGSHTWIRVSIWLVAGALIYIFYGMKHSSLASMAYHRISPL

SEQ ID NO: 22199 - protein, 271 aa, Helianthus annuus
NWGFFEIVNHGISTELLDTVEKMTKGHYKKCMEDRFKDMVASKGLEAVQNQIDDLDWESTFYIRHLPESNISEIPDLEDEYRKVMREFAKELEKLAENILDIFCENLGLEKGYLKKAFYGAKGPTFGTKVSNYPPCPKPDLIEGLRAHTDAGGVILLFQDDKVSGLQLLKDDKWIDVPPMHHSIVINLGDQLEVITNGRYKSVMHRVIAQPDGTRMSIASFYNPGSDAVIYPAPQLVNKEEEKSNIYPKFVFEDYMKLYTAVKFQAKEPRF

SEQ ID NO: 22200 - protein, 280 aa, Zea mays
RRPRVAPNPSGFSPGVGGEREKAAIAAHPLYERLLEAHVACLRVATPVDQLPRIDAQIAARPPPLAAAAGAAAAGGPSGGEELDLFMTHYVLLLCSFKEQLQQHVRVHAMEAVMGCWELEQSLQSLTGASPGEGTGATMSDDEDNQVDSEANMFDGNDGSDGMGFGPLILTEGERSLVERVRKELKNELKQGYKEKLVDIREEIMRKRRAGKLPGDTASVLKAWWQAHSKWPYPTEDDKARLVQETGLQLKQINNWFINQRKRNWHSNPTSSAEKTKKKR

SEQ ID NO: 22201 - protein, 155 aa, Zea mays
  unsure (1)..(155): unsure at all Xaa locations
MAAAAAPASVAPSPTSKAGDSRKAXVPVDVSELEKHVLAVDDSSVDRAVIARILRGSRYRVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 22202 - protein, 448 aa, Oenococcus oeni MCW
MSTANTTFLILSSVLVLFMTPGLAFFYGGLGSKKNVVNTMMSVFVMCGLAVVLWVICGYSLSFVGDFGGVFGSLSALLLHGVKLTALTSTKIPTSLYLIFQMMFAVITPALFVGAVVGRIRFKFLLLFTVFWSIFIYYPLVHMVWANGFLAKMGVIDFAGGTVVHIDAGVTALVLAYFLGPRIGYRKGKQEGHYSLPWALLGTTILWIGWYGFNAGSALAANQIAVQAVLTTTVATACSMITWMLIEMSLKGKATLAGICNGTLCGLVGITPATGYVTVAGSFWIGILAAVASYFFVNFLKARIGIDDALDAFGCHGVCGIVGSILTGLFASRAVNSSISINGLFYGGGFKLFAVQLFATLFSVIFTALICFLIIKFLKLFMKMRVDVKEEQKGLDFGEHGENVDYVISLTLEAYQFEDQKKEFFQDEPNNLKEVSKNSKDTLNSTIS

SEQ ID NO: 22203 - protein, 418 aa, Arabidopsis thaliana
MILPMLGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNECRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 22204 - protein, 527 aa, Triticum aestivum
MALEAANHYLQLAGVHGTSTPAVLLTVLLLLIIRLAWVRTATASTRFGKQQQLPPSPPGKLPIIGHLHLLGSQTHISIRDLDAKHGRNGLLLLRIGAVPTLFVSSPSAAEAVLRTHDQIFASRPPSMAANIIRYGPTDIAFAPYGEYWRQARKLLTTHMLSAKVVHSFRHGRQEEVRLIINKIRAAATRGTAVDMSELLSGYTNDVVCRAVLGESHRKEGRNRLFSELTEINVSLLGGFSLENYIPPNMVMADALLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDLSSMAYLRATIKETLRMHPPAPFLLPHFSTADCKIDGYLIPANTRVLVNAWALGRDPSSWERPEDFWPERFLQDQDGDVDTQMRGKDLRFLPFGFGRRICPGMNFGFATMEVMLANLMYHFDWDVPNMVGTGAGVDMAESFGLTLRRKEKLQLVPQIP

SEQ ID NO: 22205 - protein, 388 aa, Salmonella enterica subsp. houtenae
QNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTRRLVRAALEYAITNDRDSVTLVHKGNIMKFTEGAFKDWGYQLARDEFGGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLK

SEQ ID NO: 22206 - protein, 414 aa, Laurencia obtusa
EASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNITAATMEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYDTLLESFLKVNLPQGIFFEQDWASLRKVTPVASGGIHCGQMHQLLDYLGNDVVLQFGGGTIGHPDGIQAGATANRVALEAMVIARNQGIDYVAEGPQILRDAAKTCGPLQTALDLWKDIT

SEQ ID NO: 22207 - protein, 575 aa, Oryza sativa
MPIMALGPRTCPLPPPPPKTAKACAAAKKPRSVSSDFGEELDLEQLGAKQQQQQQERKLSRQDRVELSRSFQHAVSSHDWDGAEALVRRADAQGLNDVLCVAVDAIWFLSDKEELAAVVALIRRIVSEGANDFTRAALRTSFLASCVSACRGRTTSLADAVSFMGQKLNERLQESHGDEVLKAEASAKVHKFTEWALKCIGLHSRVRENKGRGNHGTIIEVQLQLSAFKTFLDLADNDLTGKDFTEAFDAACFPLTLFSNTFDQGWASGISAAAIQGLLELLVEGGADNVNQCFLEAARYGSTELVRILLQIARRNSLDIDVDLALGFAAHYGKLDTMGCLVEEGNAVAFLGPLMRAAERGCLQVVEWFVNLGCRDMELCLALTAATSSSQVAVAAYLLPLVPKHVLAPLSVEILKAAGERSTGSLHGVDFLLRSNFLNDPAATYAVADNIAKSADEAVDAKLRSFMLEHWSEAAFSEGFASAQEHFVNFMRIMEKGESPICLRDLPLELVIAMAYLPLYRECVESGGRLLPQKLRGQLVEAAGRLEGRQLDRASQGTELLAILEHHLPCFMIQT

SEQ ID NO: 22208 - protein, 71 aa, Nitrosomonas europaea ATCC 19718
MKIRKAVFPVAGLGTRFLPATKASPKEMLPVVDKPLIQYAVEEAWAAGITEMIFVTGRSKRSIEDHFDKGV

SEQ ID NO: 22209 - protein, 438 aa, Penicillium citrinum
MPIAKVHARSVYVSRGNPTVEVDVVTETGLHRAIVPSGASTGQHEAVELRDGDKAKWGGKGVLKAVKNVNETIGPALIKENIDVKDQAKVDEFLNKLDGTANKGNLGANAILGVSLAIAKAAAAEKGVPLYVHISDLAGTKKPYVLPVPFQNVLNGGSHAGGRLAFQEFMIVPDTAESFSEGLRQGAEVYQKLKALAKKKYGQSAGNVGDEGGVAPDIQTAEEALDLITEAIEQAGYTGKISIAMDVASSEFYKTDAKKYDLDFKNPDSDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADNWGVMVSHRSGETEDVTIADIAVGLRSGQIKTGAPARSERLAKLNQILRIEEELGENAIYAGKNFRTSVNL

SEQ ID NO: 22210 - protein, 286 aa, Pisum sativum
TGESYAGHYIPALASRIHQGNQANEGIHINLKGLAIGNGLTNPAIQYKGYPDYALDMGIITQTTHDLLGKVLVPACELAIKLCGTNGKVSCLTANVACNLIFSDIMLHAGGVNYYDIRKKCEGSLCYDFSNMEKFLNQESVRDSLGVGKIRFVSCSTEVYMAMLVDWMRNLEVGIPLLLEDGINLLIYAGEYDLICNWLGNSRWVHAMKWSGQKEFVASSDVPFVVNGSQAGLLKSYGPLSFLKVHDAGHMVPMDQPKAALEMVKQWTRGTLAESIDGEEKLVADM

SEQ ID NO: 22211 - protein, 129 aa, Glycine max
  unsure (1)..(129): unsure at all Xaa locations
VPRSRFLPVKSXSDVLLIKSGLHTMXHGQLTMNKARQFSGTPVIKLGDQFKKVSGFERRVKGGLNSVEPDHLXTVSGDVHIGKNCTFAGTVIIIATGGNKITIPDGSRLENKLVTGSLAIIDHYRVRSL

SEQ ID NO: 22212 - protein, 223 aa, Houttuynia cordata
  unsure (1)..(223): unsure at all Xaa locations
IQAGAKKVVISAPSKDAPMFVVGVNEKEYKPDINIVSNASCTTNCLAPLAKVLNDRFGIIEGLMTTVHSITATQKTVDGPSMKDWRGGRAASFNXIPSSTGAAKAVGKVLPQLNGKLTGMAFRVPTVDVSVVDLTVRLEKKASYEQIKAAIKEESEGKMKGILGYTEDDVVSTDFIGDKRSSIFDAKAGIALNDNFVKVVSWYDNEWGYSSXVIDLIRHIASV

SEQ ID NO: 22213 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRRSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 22214 - protein, 520 aa, Lycopersicon hirsutum
MKSTVHLGRVSTGGFNNGEKEIFGEKMRGSLNNNLRINQLSKSLKLEKKEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 22215 - protein, 114 aa, Klebsiella pneumoniae
SLYDIAPVTPGVAVDLSHIPTDVKIKGFSGEDATPALEGADVVLISAGVARKPGMDRSDLFNVNAGIVKNLVQQIAKTCPQACIGVITNPVNTTVAIAAEVLKKAGVYDKNKLF

SEQ ID NO: 22216 - protein, 329 aa, Arabidopsis thaliana
MTSSNGDNKGLVVSFGEMLIDFVPTESGVSLSESSGFLKAPGGAPANVAIAVSRLGGRAAFVGKLGDDEFGHMLAGILRKNDVDDQGINFDKGARTALAFVTLRSDGEREFMFYRNPSADMLLRPDELNLELIRSAKVFHYGSISLITEPCRSAHMKAMEVAKEAGALLSYDPNLREPLWPSPEEARKQIMSIWDKADIIKVSDVELEFLTGNKTIDDETAMSLWHPNLKLLLVTLGENGCRYYTKDFHGSVETFHVDAVDTTGAGDSFVGALLNQIVDDQSVLEEEERLRKVLRFANACGAITTTKKGAIPALPTDCEALSFLKIQVE

SEQ ID NO: 22217 - protein, 160 aa, Zea mays
MDARMFGLENPLVAALHHLLDVPDGDAGAGGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPQEPKKPKTIEIKVA

SEQ ID NO: 22218 - protein, 448 aa, Trichodesmium erythraeum IMS101
MNMNFKSSNPASSLALPPGDLGLPFIGQNKKIFKNPQNFIEEVYQKYGPVYKTNFLGKNFIYFQGYEAIKFILTNENKYFTYSQILRNYQRIFGENDITVLAGKEHRERQKILAKTIKSKNLNNYIDIIHDLSQSYFLKWIKSDYVDLYSEINNYTLDMILKLLLGIDYASKSEISNYLKDMSSGLNTIPVVFPWTKFGSALESKNKLFNQFEQIIVRRKKENNFGSDILGILLTVQEQMNYELTPREIVGQMVNLLSLGKKELSSALSSFFILTSEHLDVLKLLQIEQEKMDVSEPLSLDKYKKMVYLEQVIKEVLRLVPPVSGGLRKIIEDCSFQGFRIPKGWHAYYYISSVLKDPEIYKQPEIFNPERFNPTNAEDKKKPLCYIPFGGGARECIGKEFAYLVIKIFISALLDNCSWKFKENQDLTINTFPVARPAHKIEVCFTPK

SEQ ID NO: 22219 - protein, 218 aa, GIBBERELLA ZEAE PH-1
MTMNTPLDGHFVPNITFGPPVVAAIRGHVDQPTEAHGRGTFDCHMMIAEPKKWVKEFKKAGCNLYCFHYEAAFSSAAENPEDQTDEKTNPKALIRYIHDQGLLAGIAIKPDTSVDVLWEILENSEEKERPDMVLVMTVYPGFGGQKFMASELPKVQALRAKYPELNIEVDGGIGPKTIDEAADAGANVIVAGSAVFGANDPSEVIAQLRQSVDARSAK

SEQ ID NO: 22220 - protein, 521 aa, Trifolium pratense
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPIGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVDEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 22221 - protein, 101 aa, Triticum aestivum; identical to SEQ ID NO: 899

SEQ ID NO: 22222 - protein, 158 aa, Glycine max
  unsure (1)..(158): unsure at all Xaa locations
VLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPXLQLLRWKCSSCNDFGSEIIPSAVNEHNVQAYLFNDYWEDIGTIKSFFDANLALTEQ

SEQ ID NO: 22223 - protein, 506 aa, Petroselinum crispum
MMDFVLLEKALLGLFIATIVAITISKLRGKKLKLPPGPIPVPVFGNWLQVGDDLNQRNLVDYAKKFGDLFMLRMGQRNLVVVSSPELAKDVLHTQGVEFGSRTRNVVFDIFTGKGQDMVFTVYSEHWRKMRRIMTVPFFTNKVVQQYRFGWEDEAARVVEDVKANPEAATNGIVLRNRLQLLMYNNMYRIMFDRRFESVDDPLFLKLKALNGERSRLAQSFEYHFGDFIPILRPFLRGYLKLCQEIKDKRLKLFKDYFVDERKKLESIKSVDNNSLKCAIDHIIEAQQKGEINEDNVLYIVENINVAAIETTLWSIEWGIAELVNNPEIQKKLRHELDTVLGAGVQICEPDVQKLPYLQAVIKETLRYRMAIPLLVPHMNLHDAKLAGYDIPAESKILVNAWWLANNPAHWNKPDEFRPERFLEEESKVEANGNDFKYIPFGVGRRSCPGIILALPILGIVIGRLVQNFELLPPPGQSKIDTAEKGGQFSLQILKHSTIVCKPRSL

SEQ ID NO: 22224 - protein, 240 aa, Zea mays
  unsure (1)..(240): unsure at all Xaa locations
MTMKSSSGGGHVIGVPVTSKAHGIEEVSRDPSFGKGAGDHLAXVRLTHPXSPYASFGYKHSSKGQVTHWVSKLSRRAQGFREHVTLGPKLSETVKGKLSLGARILQAGGVERVFAPGFRQAFSAADKGERLLKALQCYIYTTGGPIAGMLFVSTRKVAFRSDRPITVTSPGARGDTARVTYKVAIPLRRIRRVRPSENVHRPEEKYIHVSTVDGFEFWFMGFVSYQRSCKYMQQAVSEMR

SEQ ID NO: 22225 - protein, 116 aa, Zea mays
  unsure (1)..(116): unsure at all Xaa locations
GTSRPAGIPSVRRHHIAAHELHVRSKRELYTQPPNSKIAAGATLNPVRSQESEDHPGAWNLESQYEAKLLPGLIYRMKQPKIVLLIFVSGKIVLTRAKVRDETXAFEIIYPVLVKS

SEQ ID NO: 22226 - protein, 338 aa, Zea mays
  unsure (1)..(338): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGXVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 22227 - protein, 464 aa, GIBBERELLA ZEAE PH-1
MASLRDASIDAPVAVASPQHKPSFFRSIPFQIAIACGVSFTAPGMWDALGGLGAGGAAEPYAVSAANALVYGLFAAVCILAGAINNRIGLRYGLALGAIGYPIYGAGLYTNNVAPKTWFLLFGSALCGISAGFFWAAEAAIIIGYPSPQDRAFYLAIWQSAKAAGPIVGGAINLGLNAQSSSKGSVSSATYIVFIVIMCLGLPISLFLSPAEKVQRKDQTLVVVQKQPTWAAEFKAVFSLLCTRRMLLLIPAFFISYFYNGFMSTWLTTYFTVRSRAFSSFFTNFSGIISSFLIAGLLDRQSIYIKTRARIAFLTIITILTGTWIWATILQKQFYDAAEPPVFDWFKGGFGKAYALIFFWQFGGQAFQQFLYWLIGQYTTDLSSLSYHCGILRGFEALGQTVAWAMQSEGNANHFVSIGLNFGITLLCVVPTWIVLSGLEHSHEIKVTAGTDVSRKDQEVDTKA

SEQ ID NO: 22228 - protein, 327 aa, Triticum aestivum
MLLPFALLAGAAAGAFLLFKFATADGDFTLLSCGRARRDKVEGKVVWITGASRGIGEVLSMQFASLGAKLILSARNKEELERVKRNIMSKHPDSKIEVLPMDLSSDEESLKEVVHSAESLFSSAGIDYMMHNAAFERPKRGALEETEEGLKATFHVNVFGTITLTRLLAPFMLDRGMGHFVVMSSAAGKVPTPGQALYSASKHALNGYFASLRSELCTKGIKVTVVCPGPIETPVSSGATSSSQRHSSEKRVSVERCAELTIVAATHGLKEAWISYQPVLAVMYVVQYMPTIGCWIMDKVGAKRVDAAAKKGNAYSWNLLFGGKKSA

SEQ ID NO: 22229 - protein, 231 aa, Triticum aestivum
LNSLKQTITIMSSFPLVSFLITLLLAAAVCTHGQEWVRDTNGNRVRINDQYFIQPVNTENNGGGLVPLAAKISLCLLGITQALTGEPGVRVSFSFPPSLIPPIPFSPVSTKFGITIEFKSNVCKDISKFWEVDGSSLISEEPAIQIGGNPRERNSRFKIEKVGEEGRTNIYRFTTSDGTVGAVPGPLDSSQLVLTNDVAKTIFFKLIKVNAVTTDVTSTSRVDKLGLRMIL

SEQ ID NO: 22230 - protein, 322 aa, Plectonema boryanum
MAQDQKPTVVITGASSGVGLYAAKALVKRGWHVVMACRNLEKADSAAKSLGMSPDSYTLMHIDLGSLDSVRKFVTQFRESGKSLDALVCNAAVHMPLLKEPMRSPEGYELSVATNHFGHFLLCNLLLEDLKHSTHNDPRLIILGTVTANSKELGGKIPIPAPADLGDLSGLEAGFKAPIAMIDGKPFKAGKAYKDSKLCNMITSRELHRRYHDSTGIVFNTLYPGCVADTPLFRNSLPVFQKVFPWFQKNITGGYVSQELAGERTAQVVADPEFKQSGVHWSWGNRQKEGRESFVQELSEKVTDDAKAKRMWELSEKLVGLA

SEQ ID NO: 22231 - protein, 128 aa, Glycine max
  unsure (1)..(128): unsure at all Xaa locations
DIFVDXXRDMDISVVAGXEXXGFIFGXXIALGIGAKFVPLCKXGKLPGEVISEKYVLEYGTDCLEMHVGAVQHNERVIIIDDLVATERADAEVVECACVIGLSDLKSNKLNGKPLYILVEPRQVENGF

SEQ ID NO: 22232 - protein, 249 aa, Zea mays; identical to SEQ ID NO: 20700

SEQ ID NO: 22233 - protein, 496 aa, Xylella fastidiosa Ann-1
MTHATIYQGEERRMLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPMYWVIAPTGAAACLYLFWQPFTEHWPLMVGWTVLGLVMYGLYGYHHSKLRHGG

SEQ ID NO: 22234 - protein, 469 aa, Leuconostoc mesenteroides subsp. mesenteroides ATCC 8293
  unsure (1)..(469): unsure at all Xaa locations
MSQQKNATMNADGTIRGLKKKHVQMIAIGGTIGTGLFLGAGNSIAKTGPSILIVYAVLGAFFFMMMRGIGEMLYADPSQHTFVSFISKYVGAGAGYFAGWSYWIGLLFVAMAELTAVSTYVKFWFPSWKTWIIQILFLFVLTMINLIAVRVFGETEYWFAMIKIIAIVAMIVTGLILIFTGFKAPASGGHTVASFSNVFSNFSLFPNGASMFFAAFPMVFFAFQGMEFVGITTAETENPREVLPKAINTIIIRILIFYLGAMIIIMSIINWHVIAKTPESSPFVMVFQLAGFKAAATIINFVVLTSAASALNSAIYSAGRHFYQLAEESDSKFMINFREISSNGVPAKAIIFTAILVLISPVINSIPQITSAFGLITSISSNMYIIVYAMTMYAHRKFRESTNFMPDGFLMPGYKWTSPLTLLFFVSIYASLFFQADSRVAAIGAILFTIVXXXXXXXXXXXXXXXXXQ

SEQ ID NO: 22235 - protein, 58 aa, Glycine max
MYWVSVKPWEKLRRANVQFLSAPMKDGTTGTVIVLTTPDAQRTMLAYQGTSSTVNYDA

SEQ ID NO: 22236 - protein, 540 aa, Lactococcus lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKSAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIHPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 22237 - protein, 560 aa, Pneumocystis carinii
MEHSFYERKGNEQLTSWGLLILMVLLIMALWVSYYLQDKRVRSMHETVISILLGMIVGVLIKEIKNTDIQKIVTFNYGYFFNLLLPPIILNSGYELHQELFFKNAGAIFTFAFVGTFVSAVITGLLIYLWALTGLEQIGISWIEALKFGATISATDPVTILSIFRTYNVDPTLYTIIFGESLLNDSVSIVMFETLQRFYNKEMSIIDVFIGIGRFFIIFIISLTIGIIAGISIALLLKYSHLRRFPYIESCIITLIAYSSYLFSNGCHMSGIVSLLFCAITLKHYAFYNMSIQTQFSTKFLFKILSQLSENFIFVYLGISLFTQENLVYKPLLILVTMLFVCIARYISIFSISKLINMIIESYNIVFYEKLPTSYQFMLFWSGLRGAVGVALIQALEGKEANTFKATILVVVVLTVIIFGGTTPQMLEITGIRMGITNYQDDYHMESFYNENPSLEETIYDRFQYRKSGQLDSFNVLYPFWIGSSETQGNEEDNTNRESFDSNLFFPTVTEPAKLEDISYTSYEMTNEDISTDKDKLSTSNNHIKWFKNFDSKVLMPFRC

SEQ ID NO: 22238 - protein, 469 aa, Oryza sativa (japonica cultivar-group); identical to SEQ ID NO: 12841

SEQ ID NO: 22239 - protein, 230 aa, Arabidopsis thaliana
METPSSAKRVTRSQAISAINDSDSDFKVPFSSSNKTEDSSIDQRKEEDRSALIDITNDSPIVGLTMQTPPSGFMVKRKSSRIKITPGSGEALLRGQVKTLLHKVEEGTELIHSIKTRPFIHLVTSPMRLLAPTPANTPQFPNFSDDDVKIKIASPIVAGNLRTSQISEEKEDKRMKKMNVETNQAEFAGKHNRFLYNSEDDEIVEAKEVLHLKGIPTPRGKHFRFATQEE

SEQ ID NO: 22240 - protein, 257 aa, Neurospora crassa
MDAIQTHPSNAAQAKAFTAPGSLSFPGAAGELTPPTSTANSDKSAAVNGAIGAQAANGNGVTPATPAATPAANQGPTSGMTPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASKHHNFSSYEPELFPGLIYRMIKPKIVLLIFVSGKIVLTGAKVREEIYQAFEMIYPVLQDFRKV

SEQ ID NO: 22241 - protein, 240 aa, Oryza sativa (japonica cultivar-group)
MMGRGKVVLQRIENKISRQVTFAKRRNGLLKKAYELSILCDAEVALVLFSHAGRLYQFSSSSNMLKTLERYQRYIYASQDAAAPTSDEMQNNYQEYVNLKAHVEILQQSQRNLLGEDLAPLATNELEQLESQVVRTLKQIRSRKTQVLLDELCDLKRKEQMLQDANRVLKRKLDEIDVEAAPPQPPWNGNCSNGHGGGGGVFSSEPPQPEHFFQALGLHAVDVNQPPAPPPGGYPPEWMA

SEQ ID NO: 22242 - protein, 474 aa, Anabaena azollae
MTTSQEVLKRIQDEKIPLIHLKSIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGLRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 22243 - protein, 793 aa, ASPERGILLUS NIDULANS FGSC A4
MDSGPDFEVQQPSSEPSTNNPRLPRLRDNSLSQYTREPLSDGLREPISFKRKHKHRSGFSLSNLSNIFTTDSDGHSGPSRTASRNGLTTDIDPQPAGESSQRNGNYNIQKEGGLLDWYVEGPGRRVGYDDFTAIDWIFEYTKERQRKRLLSASGKGMLGYARKVFDASNVWFVLIATGISVGIIAASIDIVSDWLGDIKAGYCKNGPGGGKFYLNRSFCCWGHEEVLGGFIIRHFMGPWTLAIKSLGLPKQQRRFSPVHAEETERELTFIARKREVLSAAAAAGISVAFGAPIGGVLFSLEQLSYYFPDKAMWQSFVCAMVATVTLQALDPFRTGNIALYEVKYTRGWHRFEMIPFVILGIVGGLYGAFLIRLNMRIAKWRKTRSFSHPIIEVVVVSILSALVNYPNIFMRAQNSELVHSLFAECSAGTPDHFGLCKTGAASAGTVALLLVAAVLGFFLTTITFGLDIPAGIILPSFAIGALYGRALGTAFKIWQDSYPGFFLFGNCEPDIPCVTPGLYAIVGAASALGGATRMTVSIVVIMFELTGALTYVIPIMIAVMLSKWCGDIFGKRGIYESWIQLNEYPFLDHREDTAPPDVPAHAVMTKTDDLTVLTAVGHTVGSLRNLLQTTSYRGFPVVMEASNPVLLGYVSRNELSYALKNPTSPSGEELSSATPVFFAHQPFADPMDTLDLRPWMDQTPITLNSGTTFLIVLRMFQRLGLRYVLFVNKGFLHGLLTKKDVWSVVNDPASREGEWTSGPLGGNDTAEEIGLLQSDDALSIAPPLTPLDRRPSF

SEQ ID NO: 22244 - protein, 464 aa, Gelidium pusillum
  unsure (1)..(464): unsure at all Xaa locations
KMGYWDPDYVVKETDVLALFRITPQPGVDPVEASAAVAGESSTATWTVVWTDLLTACDLYRAKAYKVEAVLNTSDQYFAYISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYMNVTAATMEDMYERAEFAKQLGTVIVMIDLVIGYTAIQTMAIWARKNDMILHLHRAGNSTYSRQKNHGMNFRVICKWMRMAGVDHIHAGTVVGKLEGDPLMIKGFYNTLLLTHLDVNLPQGIFFEQDWASLRKVTPVASGGIHCGQMHQLLDYLGIDVVLQFGGGTIGHPDGIQAGATANRVALEAMVIARNEGRDYVAEGPQXXRDAAKTCGPLQTALDLWKDITFNYASTDTADFVETPTANV

SEQ ID NO: 22245 - protein, 355 aa, Burkholderia fungorum
MKIAVLPGDGIGPEIVKEAVKVLNVLGEKFELEEAPVGGAGYEAKGHPLPDSTLALAKEADAILFGAVGDWKYDSLERALRPEQAILGLRKHLQLFANFRPAICYPQLTGASSLKEEIVSGLDILIVRELNGDIYFGSPRGVREAPDGLFAGSKEGFDTMRYSEPEVRRIAHVAFQAAQKRGKKLTSVDKANVLETSQFWKDVMIDVSKEYADVELSHMYVDNAAMQLVKAPKSFDVIVTGNMFGDILSDEAAMLTGSIGMLPSASLDKNNKGLYEPSHGSAPDIAGKGVANPLATILSAAMMLRYSLNKAEQADRIENAVKKVLEQGYRTGDIVTPGCKQVGTVAMGDAVVAAL

SEQ ID NO: 22246 - protein, 217 aa, Saccharomyces cerevisiae
MSSLLISYESDFKTTLEQAKASLAEAPSQPLSQRNTTLKHVEQQQDELFDLLDQMDVEVNNSIGDASERATYKAKLREWKKTIQSDIKRPLQSLVDSGDRDRLFGDLNASNIDDDQRQQLLSNHAILQKSGDRLKDASRIANETEGIGSQIMMDLRSQRETLENARQTLFQADSYVDKSIKTLKTMTRRLVANKFISYAIIAVLILLILLVLFSKFK

SEQ ID NO: 22247 - protein, 524 aa, Trifolium pratense
MLLEIAVALLVIALFIYLRPTPTAKSKALRHLPNPPSPKPRLPFIGHLHLLDHPLLHISLIRLGERYGPLYSLYFGSMPTVVASTPDLFKLFLQTHEATSFNTRFQTSAIRRLTYDNSVAMVPFGPYWKFVRKLIMNDLLNATTVNKLRPLRSKEIRKVLNVMANSAETQQPLNITVELLKWTNSTISTMMLGEAEEVRDIARDVLKIFGEYSVTDFIGPLKIFKKFGNYEQRIDAIFNKYDPIIERVIKKRQGIVNKRKNGEVLVGEEENVVFLDTLLEFAQDETMEIKITKEQIKGLVDFFSAGTDSTAVATEWTLAELINNPRVLKKAREEVESVVGKDRLVDESDIQNLPYIRAMVKEVFRLHPPLPVVKRKCTEECEINGYVIPEGALILFNVWQVGRDPKYWEKPLEFRPERFLENAGVGEGEASSIDLRGQHFTLLPFGSGRRMCPGVNLATAGMATLLSSIIQCFDLQVPGPNGQILKGSDAKVTMDERPGLSVPRAQNLVCVPLARAGAAKLLSS

SEQ ID NO: 22248 - protein, 407 aa, Methanothermobacter thermautotrophicus str. Delta H
MMLNSGDTAWMLISTALVILMTVPGVAMFYSGLTKRENVLNTIFLSFVSLGIVSLLWFLFGYGLIFGGDVSGIIGSHQVGISLINLGSASKYAPTIPEGLFAIFQMTFAAITVALISGAVVERIKFSSWILFIPLWFALVYVPVAHWVWGGGFLQNLGVHDFAGGIVVHITSGIAALALALVTGPRYDQKLMPHHLGYSVIGTGLLWFGWFGFNAGSALSAGSLAANAMIVTNTSAAAGMIGWILMDRLKTGKPTLLGALSGAVAGLASITPAAGFVDIGASIVTGLVAAVICYLAVSWLKPAAGYDDALDVFGIHGVSGIIGTLGVGLFAVPALNPSLTSGGLLTGSTSLLVSQLIGVVTVTVYTFVVTYILAMLLMKFKGLRVEREEEIQGLDINLHEETGYRLT

SEQ ID NO: 22249 - protein, 110 aa, Glycine max
  unsure (1)..(110): unsure at all Xaa locations
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSP

SEQ ID NO: 22250 - protein, 516 aa, Corynebacterium efficiens YS-314
MRGHDRLLQLASVFYFSRCHRVNQAGRTPTTPTCTIDALTCCFVDHFHPRRGVGACNSPEQVRGLRKLVCMNSQQEFVLSTIEERDIKFVRLWFTDIVGQLKSVVVAPAELESAFEEGIGFDGSAIEGYARISEADTIARPDPSTFQILPKEVETSRLQAARMFCDVTMPDGQPSFSDPRQVLRRQVQLAADEGFICMISPEIEFFLVQSLRTDGRPPVPTDNGGYFDQATFNEAPNFRRHAMLALEEMGIPVEFSHHETAPGQQEIDLRHADALTMADNVMTFRYLIKQVARDQGVAATFMPKPFAEHAGSAIHTHMSLFEGGTNAFHDPDDEFMLSRTARQFIAGILRHAPEFCAVTNQWVNSYKRIVYGNEAPTAATWGMSNRSALVRVPTYRLNKADSRRVEIRIPDSACNPYLAFSVLLGAGLKGIKEGYELEDPAEDDISSLSLRERRAMGYKDLPSSFDHALRLMERSDLVADILGEHVFEYFLRNKWREWREYQAQITPWELRTNLDY

SEQ ID NO: 22251 - protein, 324 aa, Novosphingobium aromaticivorans
MQLSREALLRAYRQMKVIREFEERLHVDIQTGEIAGFTHLYCGQEAVAVGVCEHLSVEDKIVSTHRGHGHCLAKGCDVNGMMKEIWGSREGLCKGKGGSMHIADVDKGMLGANGIVGAGAPIAVGAGIAAKIDGKGKVAITFSGDGACNQGTTFEAMNMAVVTKAATIFVFENNHYSEHTGFEYAVGTTKDIASRAEAFGMKVWRGDGTDFFSVFETMREVLDYVRVPGNGPAAVEFDTERFFGHFEGDPQRYRGPGEIDRIRETRDCLKKFRESVTAAKLLTHEDLDALDAEVMEAIEESVRQAKAADRPTAEDVLTDVYISY

SEQ ID NO: 22252 - protein, 427 aa, Batrachospermum macrosporum
IEASAAVAGESSTATWTVVWTDLLTACDLYRAKAYKVDAVPNTADQYFAYIAYDLDLFEEGSIANLTASIIGNVFGFKAVKALRLEDMRLPVAYLKTFQGPATGLIVERERMDKFGRPFLGATVKPKLGLSGKNYGRVVYEGLKGGLDFLKDDENINSQPFMRWRERYLFSIEGVNRAQAATGEVKGHYLNVTAGTMEDMYERAEFAKELGSIICMIDLVIGYTAIQTMAVWARKADMILHLHRAGNSTYSRQKIHGMNFRVICKWMRMAGVDHIHAGTVVGKLEGDPLMIKGFYDTLLLNHLSVNLPQGIFFEQDWASLRKVTPVASGGIHCGQMHQLLDYLGNDVVLQFGGGTIGHPDGIQAGATANRVALESMIIARNEGRDYVNEGPQILRDAAKTCGPLQTALDLWKDISFNYTSTDTADFV

SEQ ID NO: 22253 - protein, 407 aa, Bifidobacterium longum NCC2705
MTLLSVLDILLVIVGGAGMIYQGLCIVMSLFAKPVRFPDAPMTNRYAVLISARNEEKVIGNLIGSIRDQTYPSNLIDIWLVADNCTDNTADVVRSLGCHVVERHNLELVGKGYALTYLLGHMLDIGVADDYEAYFVFDADNKLDKHYFEEMNKAFCSGFKILTSYRNSVNLADNWVSSGSALWFIRESRFLSNSRMILGSSCHVGGTGFMFSREVMKRNKGWKFHLLTEDLEFTMDSILHGDRIGYCGTAILYDEQPVTFSQSWRQRLRWSKGFLQVFRYYGSALLKRAVRERDFSCIDFTLMLCPFTVLGAIRAVMGLLFAACGFVSWPSQLQSLAGWSSGIIISVLGLMALAALTIIVERDQIGATNKELLAYVLSFPIYMLSYVPISFQAIFAKAQWKPIAHKG

SEQ ID NO: 22254 - protein, 598 aa, Triticum aestivum
AASPAATSAAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNDLLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAVANPGVTVVDIDGDGSFLMNIQELALIRIENLPVKVMILNNQHLGMVVQWEDRFYKANRAHTYLGNPENESEIYPDFVTIAKGFNVPAVRVTKKSEVTAAIKKMLETPGPYLLDIIVPHQEHVLPMIPNGGAFKDMIMEGDGRTSY

SEQ ID NO: 22255 - protein, 543 aa, Podospora anserina
MTLLSLKEDRPTPKAVYNWRVYTCAAVASFAACTIGYDSAFIGGTLALPSFEEEFDFASYSESGRALLKANIVSVYQAGAFFGSLFAYVTSHFGGRRISLFIFSVVFCIGAGIMLAANGDRGMAPIIAGRVLAGIGVGGCSNMVPIYISELSPPAVRGRLVGIYELGWQMGGLVGFWINYGVNTTLAPSHKQWIIPFAVQLIPAGLLLIGAFWLRESPRWLFANGKKEEGLKVLCWMRNLEPTDTYILEEVSYIEADLERFEREVGKGFWKPFLSLKQRKVQWRFFIGGILFLFQNGSGINAINYYSPTVFRSIGIDGVNTGLLTTGIFGVVKTVLTIIWLLWLVDLAGRRRMLFIGATGGSLCMWYIGAYIKLAKPEQSASGELTSAGISAVFFFYLWTAFYTPSWNGTPWVINSEMFDQNTRSLGQASAAANNWFWNFLISRFTPQMFLKMEYGVYFFFASLMILSIIFIFFFVPETKSIPLEAMDRLFEIKPVHRANKLLMAELQQTSDMGHGAEESVGKDSSSTDEKMRQAGFVQAENV

SEQ ID NO: 22256 - protein, 115 aa, Triticum aestivum
FMTHYVLLLCSFKEQLQQHVRVHAMEAVMACWELEQTLQSLTGASPGEGSGATMSDDEDNQVDSESNMFDGNDGSDGMGFGPLMLTEGERSLVERVRQELKHELKQGYREKLVDI

SEQ ID NO: 22257 - protein, 306 aa, Musa acuminata
MAIPVIDFSKLDGKERAETMARIANGCEEWGFFQLVNHGIPVELLERVKKVSSECYKLREERFKGSKPVQLLDTLVKEGDGQRLDNVDWEDVFVLQDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 22258 - protein, 381 aa, Saccharomyces cerevisiae
MKSDSVEITTICPDVENSQFVVQSNCPETIPEILKSQNAAVNGSGIACQQRSLPRIKILGTGGTIASKAIDSSQTAGYHVDLTIQDLLDAIPDISKVCDIEYEQLCNVDSKDINEDILYKIYKGVSESLQAFDGIVITHGTDTLSETAFFIESTIDAGDVPIVFVGSMRPSTSVSADGPMNLYQAICIASNPKSRGRGVLVSLNDQISSGYYITKTNANSLDSFNVRQGYLGNFVNNEIHYYYPPVKPQGCHKFKLRVDGKHFKLPEVCILYAHQAFPPAIVNLVADKYDGIVLATMGAGSLPEEVNETCMKLSLPIVYSKRSMDGMVPIANVPKKGSKEDNLIASGYLSPEKSRILLQLCLAGNYTLEEIKHVFTGVYGG

SEQ ID NO: 22259 - protein, 497 aa, Taxus x media
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVSCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 22260 - protein, 470 aa, Pseudomonas putida KT2440
MDATSTTTTAKSGHESKLSASLKSRHLTMMSIAGVIGGALFVGSGSVIHSAGPAAVLAYLAGGILVVLIMRMLGEMATSSPDTGSFSTYADRAIGRWAGFTIGWLYWWYWVILMAWEAYVAGKILHGFFPDVSVNVFVLATTLLLITVNFFNVKHYGEFEFWFALIKVIAIVCFLIVCTAAVMNIWQFGEVRGISHLTAEGFMPNGITTVIGALLGVMFAFLGAEIVTIAASEAKDPAAQIVKATNSVVWRVCLFYVGSIFLIVCLVPWNDPHLGVSGYGAYRRTLELLGVPYAELLMNFVVLTSVSSCLISGHYTASRMLFSLAQRGDAPSFFKITRAGTGVPVYAIMGSCAVAVVCALINFSETLRPKDVLDTLMNTTGMIALLVYLVIAFSQLRMRRKLIAEGKEVRLKMWLFPWLTYLVIAFIVAALVTMAFMPDYQILVISTGIAAAVVVAMGVVHQIRSGSKQH

SEQ ID NO: 22261 - protein, 565 aa, Glycine max
ARAARGLSGAIPPEISNMASLQVLQLGDNQLVGNIPTQMGSLKQLSTLALQYNKLTGQIPLSLGNLEKLSRLNLSFNNFSGTVPATLAYIEHLEVLDIQNNSLSGIVPSALKRLGEGFQGANNPGLCGVGFSTLRACNKDQDLNVNHIDTSDGDQPKNSNSSKALPEPAYVQLHCGQTHCSKSRRFPQTVITAGVVIVTLTFICAGFLTFFRYRRQKQRISNTLSSSSEGKVSLDQPKEFYTKSPSALVNIDYYSGWDQLSNGQNADAGGLSNEYLNQFRFNVDEVESATHYFSEANLLNRSKFAAGYKGVLRDGSLVAIRSISVTCCKTEEAEFVKGLNLLTSLRHENLVRLRGFCCSRSRGECFLIYDFATMGNLSQYLDIEDGSSHVLEWSKRVSIIKGIANGIGYLHSNEESKPTIVHQNISVENVLLDYQFNPLIRDAGLPMLLADDVVFSALKVSAAMGYLAPEYITTGRFTEKSDIYAFGVIILQVLSGKTTIGSSIRTAVESFRFDDSVDTNLKGIYSKSEAATLSKLAIQCTNELPDERPTMVDVIQELSVLSAHL

SEQ ID NO: 22262 - protein, 158 aa, Petroselinum crispum
MDFRLMGFNHPLLNTLSPHCDEDNQDSSNKNKSEQARSYVRDAKAMATTPADVKEYPNSYVFVVDMPGLKSGDIKVQVEEDNVLVVSGERKREEEKEGVKYVRMERKVGKFMRKFVLPENADLENINAVCQDGVLSVTVQKLPPPEPKKPKTIEVKIA

SEQ ID NO: 22263 - protein, 443 aa, Zea mays
VLGIIGGIFGGLFNYLLDKILRVYSIINERGAPFKILLTITISIITSMCSYGLPWLAACTPCPVDAVEQCPTVGRSGNYKNFQCPPGHYNGLASLFFNTNDDAIRNLFSNGTSTEFQMSSLFIFFTAIYCLGLVTYGIAVPSGLFIPVILAGATYGRIVGTLLGSISDLDPGLFALLGAASFLGGTMRMTVSVCVILLELTNDLPMLPLVMLVLLISKTIADSFNKGVYDQIVVMKGLPYMEAHAEPYMRHLVAGDVVSGPLITFSGVEKVGNIVHALRLTGHNGFPVLDEPPITETPELVGLVTRSHLLVLLNSKNFMKGRVKTSGSFVLRRFGAFDFAKPGSGKGLKIEDLDFTDEEMDMYVDLHPITNTSPYTVVETMSLAKAAILFRELGLRHLLVVPKTPDRPPIVGILTRHDFMPEHIHSLFPNLNPHKYHSASMAG

SEQ ID NO: 22264 - protein, 424 aa, Grateloupia imbricata
DTDVLALFRVTPQPGVDAVEASAAVAGESSTATWTVVWTDLLTACDLYRAKAYKVDAVPNSSEQYFAYIAYDIDLFEEGSIANLTASIIGNVFGFKAVKALRLEDMRIPVAYLKTFQGPATGVVVERERMDKFGRPFLGATVKPKLGLSGKNYGRVVYEGLRGGLDFLKDDENINSQPFMRWKERFLYSMEGVNRSIAATGEIKGHYMNVTAATMEEMYERAEFAKQLGTVIIMIDLVIGYTAIQTMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALEAIVIARNEGRDYVAEGPQILQDAAKTAAPLHK

SEQ ID NO: 22265 - protein, 364 aa, ASPERGILLUS NIDULANS FGSC A4
MPYPEEAEGFQVDSPETYTDFKKRFFKLKPFGDYDVDIKIEACGVCGSDVHTISVIGGWGSQKFPLCVGHGPEIIGRAVRVGPKVTLIKEGQRVGVGAQSYSCGECKQCKNENETYCPVLMIDTYGAEWPDTGIVSQGGYSSHVRTHEHWVFPIPDVLETNLVAPMLCAGLTAYSPLVRNGAGPGKKVGIVGLGGIGHFGVMFAKALGAETWAISRSRAKEADARKLGADGYIATAEEGWEKPHRCSFDLIINCANSSKGFDLEKYLSMMDVHGRWISVGLPEEEGQVIKAQNLISNGVLIGASHLGSRREMLEMLQLAADKGLRGWVEELQIGSEGLKEAMERMKKGDVHYRFTMTGYDKVFG

SEQ ID NO: 22266 - protein, 116 aa, Pectobacterium carotovorum subsp. carotovorum
AGIVRNLVEQIAVTCPKACIGIITNPVNTTVAIAAEVLKKAGVYDKNKLFGVTTLDIIRSNTFVAELKGKQPQDINVPVIGGHSGVTILPLLSQVPGISFSEQEVADLTKRIQNAG

SEQ ID NO: 22267 - protein, 477 aa, Laurencia catarinensis
KNERYESGVIPYAKMGYWDPNYVVKDTDILALFRVSPQPGVDPVEASAAVAGESSTATWTVVWTDLLTACDLYRAKAYKVDAVPNTSDQYFAYIAYDIDLFEEGSIANLTASIIGNVFGFKAVKALRLEDMRIPVAYLKTFQGPATGLVVERERMDKFGRPFLGATVKPKLGLSGKNYGRVVYEGLKGGLDFLKDDENINSQPFMRWKERFLYSMEAVNRSIAATGEVKGHYMNITAATIEDMYERAEFAKQLGTVIVMIDLVIGYTAIQTMAIWARKNDMILHLHRAGNSTYSRQKIHGMNFRVICKWMRMAGVDHIHAGTVVGKLEGDPLMIKGFYNTLLEPYLAVNLPQGIFFEQDWASLRKVTPVASGGIHCGQMHQLLDYLGNDVVLQFGGGTIGHPDGIQAGATANRVALEAMVIARNEGRDYVAEGPQILRDAAKTCGPLQTALDLWKDITFNYTSTDTADFVETPTANV

SEQ ID NO: 22268 - protein, 147 aa, Synechocystis sp. WH 8501
MALLRYNPWTEMNALQRQINQLFDDGVLTTSERGLKEAIFAPSAELSETDEAVMLKLELPGVKAEDVDIQATKEAIYITGERKKETKSEENGVTRSEFRYGKFSRFIGLPALIDNTKISAEYKDGILNLTLPKAEEEKHKVVKITLG

SEQ ID NO: 22269 - protein, 203 aa, Glycine max
  unsure (1)..(203): unsure at all Xaa locations
MKSSDTSPQHDDYLLHKSISVDGYTYTNTDKEITAKGTGKSSNFTHRIHNHVKMGPNLSEILKGKLSLGARIIQEGGRGNIFKSVFGMQEKEQLXKASQCYLYTTAGPIAGILFVSTAKVAFYSERPITFSSVTGELVRAPYKVLIPIGRIKEVNESQNVSKAEQKYIEIVTEDDFEFWFVGFLRYDKAVKHINKAISMAYKF

SEQ ID NO: 22270 - protein, 329 aa, Oryza sativa (japonica cultivar-group)
MALEAVVFPQGHFGYGCGRDSPAYGMPWCDVLAAAGGGGGFGEFYGVDEWDDQLQVASVDEWEVASKDNSDASTEGKAAAAERAEPVAAGRRKRRRTKVVKNKEEIECQRMTHIAVERNRRRQMNEYLAVLRSLMPASYSQRGDQASIVGGAINYVKELEQLLQSLEVQKSLKNRSGAMDAAGDSPFAGFFSFPQYSTSPRTGCSAAASAGSSGSASSVVMDDTAGSAESGRQSAAIADIEVTMVEGHASLKVLARRRPKQLLKLVVGLQQLRIPPLHLNVTTVDAMVLYSFSLKVEDDSKLGSVEDIATAVHQILGSIQQQEAVLSIS

SEQ ID NO: 22271 - protein, 499 aa, Ferroplasma acidarmanus
MEKMEKIFGNIINGIEETGGERIELKSPVDGSLIGYIIDTDKDTVERAIQSSREAFNKFYLESTIKSRQELIGKLTDIVQEKATIYADLESKNTGKTIRQSTFMDIPLAISHIRYFAETDEFKFQRKITHPEYPGTEGIVQNAPMGVVASIAPWNVPFLMAVWKIIPPVLAGNAVVIKPSHYTPLTAIELVKDMKAAGFPDGLVNLVNGTGRTTGNLLVNSDHVDMVSFTGSTPTGSRIMEQAAKNIKKVSLELGGKSPNIVFADADLDHAVKGVIFGIFLNAGQLCESASRLIIEESIMDKFLQKVKTYLDSMKSGNPMDFETDISAITTKEQKEKIESLISQTVKSGGNIFYSKNMQGTPDKGTYFPPTLLTGLTPGQQISDEEIFGPVLTVYPFKSEKEAIDLANSTKYGLAAGIWTKDIEKAGRVASMIEAGTVWVNEYHLLSAAAPRGGFKKSGIGRELGLEGILEYTQTRHIFYGNNESGMSDVAYGILIKTE

SEQ ID NO: 22272 - protein, 378 aa, Zea mays
MALSKEQKLTIPDQQHTTSSEQQVALDAELQLWNHTFGYVKSMALKAALDLGIPDAIHQHGGSATIPQIVTRITLHPSKTPCLRRLMRVLTLTGVFGTQEPHDDGGGCDDELVYTLTPASRLLVGPSGQNVSPLLNVMLCPILVSSFLDLRGWFQHEMPDPSPFKVTHGRDIWELAAHDAGFRRLVESPGLQADSGFIMNVVVRECGSGTVFQGISSLVDVGGGFGGATQAIAKAFPHLECSVLDLPNVVAGAPADTAVKYVAGDMFESVSSADAVFLKSIIHDWGDADCVKILKNCKKAIPAQGGKVIILDIVVGAGSSSCDRKNVETQCLFDLYIMTINGVERDEREWKKIIFEAGFTSYKIIPVLGTRSIIEVCP

SEQ ID NO: 22273 - protein, 499 aa, Eremothecium gossypii
MLSVGRKHNKTHSTYAFESNTNNVAASQMRNVLNKLADSVKDEKTRCRFENELDSFFTLFRRYLVEKSSDTTLEWEKIKSPSAEEVTAYSDIGASENLASLEKLAVLKLNGGLGTSMGCVGPKSVIEVRDGNTFLDLSVRQIEYLNRQYDSDVPLLLMNSFNTDADTEHLIKKYSANRIRIRSFNQSRFPRVYRDSLLPVPQDYNDKLDAWYPPGHGDLFEALHASGELDALLAQGREILFVSNGDNLGATVDLKILNHMIETGAEYIMELTDKTRADVKGGTLISYEGQVRLLEVAQVPKEHIDEFKNIRKFTNFNTNNLWINLKAIKRLVESSSLTMEIIPNKKTITRNGNEIEVLQLETACGAAIRHFKGAHGVVVPRSRFLPVKTCSDLLLVKSDLFYLEHGALKLDPSRFGPNPLIKLGSHFKKVSGFNAHIPHIPKIIELDHLTITGNVYLGKNVTLKGTVIVVCSDGQRIDIPNGSVLENVVITGNLQILEH

SEQ ID NO: 22274 - protein, 404 aa, Oryza sativa; identical to SEQ ID NO: 4844

SEQ ID NO: 22275 - protein, 316 aa, Arabidopsis lyrata
SKEVAPDNEFEKRIRPEVIPANEIGVTFADIGSLDETKESLQELVMLPLRRPDLFKGGLLKPCRGILLFGPPGTGKTMMAKAIANEAGASFINVSMSTITSKWFGEDEKNVRALFTLAAKVSPTIIFVDEVDSMLGQRTRVGEHEAMRKIKNEFMTHWDGLMSNAGDRILVLAATNRPFDLDEAIIRRFERRIMVGLPSVESREKILRTLLSKEKTENLDFHELAQMTDGYSGSDLKNFCTTAAYRPVRELIKQECLKDQERKKKEEAEKSSEEGSETKEEVSEERVITLRPLSMEDMKVAKSQVAASFAAEGAGM

SEQ ID NO: 22276 - protein, 548 aa, Hypocrea jecorina
MPIGNIYVIAGVSVVGGALFGFDISSVSAQLAEQSYLCYFNQDENPPTTVDGTCGGPRSLVQGGITASMAAGSWLGALISGPLSDRLGRKYSIMVGCIIWVIGSTLSCASQNIGMLIVARIINGLSVGIESAQVPVYIAEISPPSKRGRFIGMQQWAITWGILIMYYISYGCSFIGKQNPLEYNTASWRIPWGLQMIPAFFLFFMMMPLPESPRWLARKDRWEDCRAVLTLVHGKGDPNHPFVAYELQDIKDMCEFERRHADVTYLDLFKPNMLNRTFIGLFTQIWSQLTGMNVMMYYIANIFSMAGYSGNANLLASSIQYIINVLMTIPALLWVDKWGRRPTLLVGSVLMALWMYANAGILATYGEVVPGGIDHVAAQSMRVSGAPAKGLIACTYLFVASFAPTWGPVSWTYPPELFPLRLRGKGVALATSGNWAFNTALGLFTPVAFANIKWKSYLIFAIFNTVAFFHVFFVFPETAGKTLEETEAMFEDPNGIKYLGTPAWKTRVATSLTERAEHGDIEAKIGHDTEKPPVHTHEEEKASTPPPQ

SEQ ID NO: 22277 - protein, 159 aa, Triticum aestivum
  unsure (1)..(159): unsure at all Xaa locations
MXPTVMGSSGTSVAPFXGLKSTAGLPVSRRSNXASLGSVSNGXRIRCMXVWXIEGIKKFETLSYLPPLXTEXLLKQVDYLIRSKWVPCLEFXKXGFIFREHNASPXYYDGRVXWQMWXXCYVPGAPTPTQVINGWGGGQKSNLDYVRHHSFRQQAKVQL

SEQ ID NO: 22278 - protein, 316 aa, Oryza sativa
SGSPGCRHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPFRHAPSTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 22279 - protein, 210 aa, Triticum aestivum
MRMYQVLLFMNSFGNCILQIGVAAASLQDGSAVTVDAQRFIQGSLYKSAMESKKQSYLANLALYPGRTELPFLPANTQALILQPIGDKGIAVIGGDTIRGFTNLDQAWIGMIADKLDATLSKVLSSHCPLDIRLMIISLFNWPIHPDHICLDPRKSSGYMWELKREFTKEHLPHPNITGSAFGEIWLTKIMGLYICPTANNVHDPSFQSF

SEQ ID NO: 22280 - protein, 199 aa, Pseudomonas syringae pv. tomato str. DC3000
MLLMIDNYDSFTYNVVQYLGELGADVKVIRNDELTIAQIEALNPERIVVSPGPCTPNEAGVSLEVIKHFAGKLPILGVCLGHQSIGQAFGGDVVRARQVMHGKTSPVVHEDGGVFAGLNHPLVVTRYHSLVVKSDTLPECLEVTAWTALEDGSVDEIMGLRHKTLNVEGVQFHPESILTEQGHELFANFLKQSGGHRQG

SEQ ID NO: 22281 - protein, 363 aa, Magnetospirillum magnetotacticum
MVDLLGQAQRPLMLVGGGGWNAESAGLITTFAEGWNLPVAVCFRRQDIIDNESPSYGGELGYSMAPSLGARVKQADLILAVGTRLGDIDTAGYSLIEAPNPKQTLIHIFPEAEELGRVYRPHLAIVSAMLPFARRAAQLSPPTRIPWTDWARSVRDDHLANRIPNPCPGALDMGQVMAEIEKRLPDDAIICTGAGNYTGWPQRFHRFRRYPGQLAPANGSMGYGLPAALAAKSLHPDRIVLAFAGDGCFLMTGQELATAKLHGLAPVILIVDNGMYGTIRMHQEASHPGRTLATDLANPDFAALAASYGAWTARVERTEDFAPAFDQALAAGRLAVLHLVMDPEAITTRTTLSAIRDKARAKA

SEQ ID NO: 22282 - protein, 381 aa, Medicago sativa
MSCSVAVSNSPVFSPSSSLFCNKSETLTLSLSHLKPSSTTTTTTTSSSSSSSSPSPCSSPSSPFCLRLPKLPLVFTSNKDSGSQNDAVLKRKRPTRLNIPVSEHAFCVPATPSAVARDVVEAEGDGYSVYCKRGRREYMEDRYTAGVNLRGENNLAFFGVFDGHGGAKAAEFARNNLEKNILDEVIMTDEDDVEEAVKRGYLNTDSEFMKKDLHGGSCCVTAFIRNGNLVVSNAGDCRAVISRGGVAEALTSDHRPSREDEKDRIETLGGYVDLCRGVWRIQGSLAVSRGIGDRHLKQWVTAEPETKVIRIEPEHDLLILASDGLWDKVSNQEAVDIARQFCVGNNNQQPLMACKKLAQLSVSRGSLDDTSVMIIKFKHYV

SEQ ID NO: 22283 - protein, 509 aa, Nicotiana tabacum
MEGTNLTTYAAVFLGTLFLLFLSKLLRQRKLNLPPGPKPWPIIGNLNLIGNLPYRSIHELSLKYGPVMQLQFGSFPVVVGSSVEMAKIFLKSMDINFVGRPKTAAGKYTTYNYSDITWSPYGPYWRQARRMCLTELFSTKCLDSYEYIRAEELHSLLHNLNKISGKPIVLKDYLTTLSLNVISRMVLGKRYLDESENSFVNPEEFKKMLDELFLLNGVLNIGDSIPWIDFMDLQGYVKRMKVVSKKFDKFLEHVIDEHNIRRNGVENYVAKDMEDVLLQLADDPKLEVKLERHGVKAFTQDMLAGGTESSAVTVEWAISELSKKPEIFKKATEELDRVIGQNRWVQEKDIPNLPYIEAIVKETMRLHPVAPMKATECRENSKVAGYDVQKGTRVLVSVWTIGRDPTLWDEPEVFKPERFHEKASIDVKGHDYELLPFGVGRRMCPGYSLGLKVIQASLANLLHGFNWSLPDNMTPEDLNMDEIFGLSTPKKFPLATVIEPRLSPKLYSV

SEQ ID NO: 22284 - protein, 762 aa, Glycine max
  unsure (1)..(762): unsure at all Xaa locations
MWRLKIADGGNDPYIFSTNNFVGRQTWEFDSEAGTAEERAQIEAARQNFYENRFMVKACGDRLWRFQILRENNFKQTISGVKIEDDEKITCEKIRSTMKRATHYLSSLQTSDGXWPAHLXGSLFFTPPLVICLYITGHIDSIFSEEYRKEILRYIYYHQNKDGGWGLHIEGHSIMFCTTLNYICMRILGEGPNGGHNNACAKARKWIHDHGGATHIPSWGKFWLSVLGIVDWCGSNPMPPEFWILPSFLPMHPGKMWCYCRLVYMPMSYLYGKKFTGPITPLVVNLREELFIQPYDENSWKKARHKCANEDLYYPHHWIQDLLWDSLYVFTEPLLNCWPFNKLVREKALQVTMKHIHYEDENSRYIAIGCVEKVLCMLACWVEDPNGDAFKKHLARIPDYLWVSEDGMTMQGIGTQSWDVGFIVQALLATNLIDDFGPTIAKAHDFIKKSQVRENPSGDFKSMYRHICKGSWTLADRDHAWQVSDTTAECLKCCLLLSVLPQDIVGEKMELEKLHDSINLILSLQSKNGGMTAWEPAGAYKWLELLNPTEFFADIVVEHEYLECTASAIQVLVLFKKLYPEHRKEEIENFIAKAVTFIEDTQLENGSWYGNWAVCFTYSSWFALGGLVAAGKTYTNCVTIRKAVKFLLKIQNKDGGWGESYLSCPRKMYVPLEGSRSNVVQTSWALMALIHAEQAERDPTPLHHAAKLLINSQLEDGDWPQQETLGVYLRNCLVHYSFYRNIFPMWALAEYRTNVLLPSFTI

SEQ ID NO: 22285 - protein, 187 aa, Saccharomyces cerevisiae
MSIASYAQELKLALHQYPNFPSEGILFEDFLPIFRNFGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 22286 - protein, 608 aa, Thermobifida fusca
MGVFLLPVTRYPPSPKDLVMTEQMTGAQSLIRALEHVGVDVVFGIPGGAILPAYDPLYDSTKVRHILMRHEQGAGHAAEGYAYATGRPGVCIATSGPGATNLVTPLADAYMDSVPVVAITGQVASPAIGTDAFQEADICGITMPITKHNFLVRDPSKIASTIAEAFHIASTGRPGPVLVDIAKDALQAQTRFEWPQRPELPGYRPVTKPHGKQVREAARLIAEAKRPVLYVGGGVFKSGASKELRVLAELTGIPVVTTLMALGTFPSSHPQNLGMPGMHGTVAAVGALQRADLIVALGARFDDRVTGKLSSFAPHATIVHADIDPAEISKNRYADVPIVGDCREVIADLIVAVRADQAAGRQGDYTAWWEQLNRMRETYPLGYTEPEDGSLAPQYVIKRIGQIVGPDATYVAGVGQHQMWAAQFIDHQRPGSFVNSGGAGTMGFAIPAALGAKVGDPDRVIWAIDGDGCFQMTNQELATCAIEGIPIKVAVINNGNLGMVRQWQTLFYDGRYSNTNLHTAPTPEDGKVRIPDFVRLAEAYGCVGLRCDRAEDVDATIEKAMAINDVPVVIDFTVHHDAMVWPMVPAGVSNDDIQYARDMAPEWDDEEE

SEQ ID NO: 22287 - protein, 157 aa, Triticum aestivum
  unsure (1)..(157): unsure at all Xaa locations
REHSDNMNYLRLDIRPEADGDRMTSADIMQVIEKSLGRLAKXCESSLGTRNLXKMCNAMYRFECHNNSLQVQSEFMDGAMNGCTSLSKLDSEIKSLMLDVSDDYGLHVSVDVTQDASIHVSTANDNDRVDEDDLTGRLDQVYVRVYTERTSLHCKYC

SEQ ID NO: 22288 - protein, 711 aa, Oryza sativa
MPASRNKYPPRHEQQHPQQIHNPNPETSRTQPNSPPINSPMAAAIIGVGGGGWTRLRSIGHGASGATVSLAADDASGELFVVKSAGDAVAATARQQLRREWSVMSGLSSPHVLRCLGFVQAAAGAGGEHQLLLEYAPGGSLADVVARNGDRLDESAFRAYAADVLRGLDYLHEKLVVHGDVKGSNVLVGADGRAKLADFGCARVVMPGGSKQPVLGGTPAFMAPEVARGEEQGPAADVWALGCTVIEMATGRAPWSDMDDVLAALRMIGYTDAVPDLPPWLSPEAKDFLRRCMQRRAGDRPTAAQLLQHPFVSKSCGLKKEVVKATWVSPTSALDAAAALWESETSSSTDDEEADDMSNSPTGRIIAMASSGGQTLPDWDSDDHGWIEVLGTVSINIAKKKTAAAEDYEASESPAKRVRAMACSPSSVPDWDSDNHGWIDVLSASPADDNGGEGNAPEEFDVVAAADQIFGEAVGSIVVGVGSEQSVVVENQEDEFISLSYCSERILLVAVHAADNNAASRKAGIKECSHDPRPSIPSRCAHNLFLSLIFIQIDNSNVLMSEAGTVPRRVAVQRGEVKDELERVLLHLSAPHGPSAWSGPGASVGPCRPDKPRPRHGRAWAVPCRVAHMTIYSWGEAATIVCQLRRGVTIYRMPPPKPIVVVVLVIMVLVIVARPQRYCATKVTKMGVARSGCHAHIATHLRSPSLCPSYY

SEQ ID NO: 22289 - protein, 345 aa, Emericella nidulans
MGKYASDSEWASIDPIPLNDGSESGAMPLATIAYSEEYLEATSYLRAVMAANEMSDRALKLTEDIISMNPAHYTVWIYRAKIVFALNKDLLEELEWLNGVSLRYLKNYQIWHHRQVIMSSREHFPSLPPKEMDFLMEMFAQDSKNYHVWTYRHWLVRHFELWDSPRELADVNSLLNSDVRNNSAWNHRYMLRFGPRSNEPDAGMVNTGGSPAEKGRLAVVDEDLVDEELRYAQDQILRAPENRSPWSYARGILRAASRPLSEWTEFAQKFVVDKRDDQGQIVDVSVKSSHAVEWLADVYADAEENGRAEAVRMLNLLKDKYDPIRKNYWNYRIRTIEAEEVPASA

SEQ ID NO: 22290 - protein, 338 aa, Prochlorococcus marinus subsp. marinus str. CCMP1375
MKNPNVICFGEALVDRLGPLGGDPASDKPVDDCLGGAPANVASGLARLGINAAFVGCLGNDSIGNQFRELFMARGVNFAGLQIHESLLSRIVLVYRDLNGERSFGGFAGDQSNIFADQYLDLNVHKKIFPSLLDEAKWLLLGTIPLAVEHSREVVQWTIEQSLNNGLQIAFDLNWRPTFWDINMTPNNPPDTKTCSLITSFLEHASLIKLAKEEAEWFFNSKDPWEISNALPEKPSVIVTDGAQPINWVLGGFSGQTPALSPQKVVDTTGAGDAFMAGLMTQIISFSSQPKLFSEAEAMIQFSAGCGALVCGAPGAIEPQPSYSEVQSLLSSFLNDRS

SEQ ID NO: 22291 - protein, 279 aa, Ralstonia metallidurans
MPTMTDRYFSFEFFPPKTAEGAEKLRNTRAQLAPLQPKYISVTFGAGGTTQQGTLDAVLEIQREGIEAAPHLSCVGSTRDSIRQILQTYRDGGIRHIVALRGDMPSGMGEIGEFRYANELVEFIRAETGDWFNIEVAAYPEYHPQARSPRHDLENFVRKVKAGADSAITQYFFNADAYFRFVDDVRAMGVEVPIVPGIMPITNYSQLMRFSEMCGAEVPRWVAKRLESFGDDKEAIRAFGLDVVTDLCTRLLEAGVPGLHFYTLNAAGATKAIWQRLKL

SEQ ID NO: 22292 - protein, 243 aa, Zea mays
MFGYRKADPDLEAGGSSLLYPGMTESPELRWAFVRKIYVILTVQLAMTAAVSAFVVKVPAVSNFFVSSNAGIALYIFLIVLPFIVLCPLHYYHQKHPINLLLLGLFTVAISFAVGMTCAFTSGKIILEAAILTAVVVNSLTAYTFWAAKRGHDFNFLGPFLIAAIMVLMVFSLIQIFFPLGKISVMIYGGLASLIFCGYIIYDTDNIIKRHTYDQYIWAAVSLYLDVINLFLSLLQLLRAADS

SEQ ID NO: 22293 - protein, 380 aa, Zea mays
MADRANHPSVMQKFGGQFHLASSFSEGVRARNICPSVPSYERRFTTSSYMTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGERQFNGLVDVYRKTLKSDGIAGLYRGFNISCVGIIVYRGLYFGLYDSIKPVVLTGSLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 22294 - protein, 495 aa, Pseudomonas aeruginosa PAO1
MSIAIDPSVSAFLRSPHGLLIDGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 22295 - protein, 486 aa, Gelidium elegans
  unsure (1)..(486): unsure at all Xaa locations
NSVEERTRIKNQRYESGVIPYAKMGYWDPNYAIKETDVLALFRITPQPGVDPIEASAAVAGESSTATWTVVWTDLLTACDLYRAKAYKVEKVPNSDDQFFAWISYDIDLFEEGSIANLTASIIGNVFGFKAVKALRLEDMRIPVAYLKTFQGPATGIIVERERMDKFGRPFLGATVKPKLGLSGKNYGRVVYEGLKGGLDFLKDDENINSQPFMRWKERFLYSMEGVNRSIAATGEIKGHYXXXXXXXXXXXXXXXXXXXXXXXXXXMIDLVIGYTAIQTMAIWARKNDMILHLHRAGNSTYSRQKNHGMNFRVICKWMRMAGVDHIHAGTVVGKLEGDPLMIQGFYNTLLMSHLDQDLVKGIFFEQDWASLRKVTPVASGGIHCGQMHQLLDYLGVDVVLQFGGGTIGHPDGIQAGATANRVALEAMVIARNEGRDYVKEGPQILRDAAKTCGPLQTALDLWKDISFNYTSTDTADFVETPTANV

SEQ ID NO: 22296 - protein, 475 aa, Staphylococcus aureus subsp. aureus MW2
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPKKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 22297 - protein, 185 aa, Triticum aestivum
KYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDKNRSIG

SEQ ID NO: 22298 - protein, 117 aa, Schizosaccharomyces pombe
MSKHHPDLVLCRRQPGITVGKLCERCDEKCPICDSHVRPTTLVRICDECAFGSSQDRCIICGAPGVSDCYYCSECTRMEYDRDGCPRVINLGSSRTDWFYERKKFKNAGKEMPGATY

SEQ ID NO: 22299 - protein, 179 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAEGMGQQGAYNQGMGYMQPQYHNGDISNV

SEQ ID NO: 22300 - protein, 381 aa, Glycine max
  unsure (1)..(381): unsure at all Xaa locations
KQTQENTGLWTYNQLADGPFFDLVGNNLPVFFVRDGMKFPDMVHALKPNPKNHIQENWRILDFFSHXPESLHMFTFLFDDLGVPQDYRHMDGFGVNTYTLINKAGKAVYVKFHWKTTSGIKCLLEEEAIKVGGANHSHATQDLHDSIAAGNYPEWKLFVQTIXDPEHEXKFDFDPLDVTKTWPEDIIXLQPVGRLVLNKNIDNFFAENEQLAFCPAIVVPGVYYSDDKMLQTRIFSYADSQRHRLGPNYLQLPANAPKCAHHNNHHEGFMNFIHRDEEVNYFPSRYDPVRHAERFPIPPAICSGRREKCGIEKENNFKQPGERYRSWAPDRQDRFARRWVDALSDPRVTHEIRSVWISYWSQADRSLGQKIASHLSTRPNI

SEQ ID NO: 22301 - protein, 337 aa, Tropheryma whipplei TW08/27
MTVKIAINGFGRIGRGFFRALSSPSCIDGPEIDVVAINDLTSPEVLAHLLRRDTIFGRFPESVCHDGTKLLVGKREVAVFSEKDPSSIPWNGVDIVIESTGLFTDANIASGHITAGSKRVIISAPAKNEDATFVVGVNHTDYDPNKHSIVSNASCTTNCLAPLAKVFDDTFGIERGLMTTVHAYTADQRLQDAPHSDLRRARAAAMNLVPTSTGAACAIGLVLPNLKGKLDGFAIRVPVITGSITDLSLVSKTDVSAPEVNEAYRRAALGPLKGILCYSEDPLVSSDIVADGHSCIYDANLLRISGNMVKLSAWYDNEWAYSRRLVDLAKYMASVGL

SEQ ID NO: 22302 - protein, 470 aa, Glycine max
  unsure (1)..(470): unsure at all Xaa locations
MAHFEKDEVPMLSETHARLSDEVVDSNFRRLVSRTRSASISIPMASLESYEKETNLVGHTGPLRSVRKTPFVQMSGPLYATNGTGNLSRQNIVATGTKVVESKTEKFSTFDGTNENRWDNDYDRKNEHLMRSGQLGLCKDPYSTTSPTYFKASQPTTRRTSAIFDPKYRMAYVSPESREVGAGDXLDHPKKIALNYLKGYFFIDLFVVLPLPQIMILFVLPKYLGLSGANYAKNLLRAAILVQYFPRLFRFLPLLIGQSPTGFIFESAWANFIINLLIFMLSGHVVGSGWYLFGLQRVNQCLRNACRDSNITGCSAFIDCCYGADDVSGRAEVWNNNVNATACLNSSSDAFKYGIYVNAVPLTIETRVVHKYVFALFWGFQQISTLAGNQTPSYFVWEVLFTMAIIGLGLLLFALLIGNIQNFLQALGRRRLEMQLRGRDVEQWMSHRRLPEDLRRRVRHAERYSWAATR

SEQ ID NO: 22303 - protein, 474 aa, Synechocystis sp. WH 8501
MAETPQEVLKMIQDNNIQIIDLKFIDLPGIWQHCSFYHNQIDEDSFDAGVPFDGSSIRGWKAINESDMCMVPDPKTAWIDPFYEEPTLSLICSIKEPRTGEWYSRDPRTIAKKAVEYLQSTGIGDTAFFGPEAEFFVFDDVRFDQTENKAYYSVDSVEGRWNTGREEEGGNLAYKPGYKQGYFPVSPTDTLQDMRTEMLLTMAKCGVPIEKHHHEVATGGQNELGFRFATLIDAADYLLTYKYVIKNVAKKYGKTVTFMPKPLFNDNGSGMHVHQSIWKGGQPLFWEEGTYADLSKLATHYIGGILKHAPALLAFSNPTTNSYKRLVPGFEAPVNLVYSQGNRSASIRIPLTGSNPKAKRLEFRCPDATSNPYLAFAAMLCAGIDGIKNKIEPAEPLDVDFYELSPEELSKIPSTPGSLEQALECLGKDHAFLTDGGVFTEDFITNWIEYKLDNEVNPLRLRPHPYEFALYYDV

SEQ ID NO: 22304 - protein, 474 aa, Prochlorococcus marinus subsp. marinus str. CCMP1375
MVHYEKLSPPTTGEKIKFNNGLPIVPANPIIPYIRGDGTGVDIWPATQKVIDQAIEKAYGIDRKIEWFKIYAGDEACDLYGTYQYLPKDTIEAIREYGVAIKGPLTTPIGGGIRSLNVALRQKFDLYSCVRPCRYYQGTPSPHKHPENLDVIVYRENTEDIYIGIEWESNDPIGIKLIEHLNNDVIPASPSLKNRIIPQGSGIGIKPVSKDGSQRHIRRAIQHALKLNGNKRHVTLVHKGNIMKFTEGSFRDWGYELATNEFRNECITERESWILSNLEQNPRLSIENNAKLIDPGYESLTKEKKDIICNEVQLVINNIHKTHGNNKWKKMVLVDDRIADSIFQQIQTRPQEYSILATLNLNGDYISDAAAAIVGGLGMAPGANIGDRAAIFEATHGTAPKHAGLDRINPGSVILSGVMMLEYIGWQEAADLITKGLSQSIYDKQVTYDLARLMEPPQSPLSCSEFANAVIERF

SEQ ID NO: 22305 - protein, 335 aa, Streptococcus pneumoniae TIGR4
MVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 22306 - protein, 294 aa, Klebsiella pneumoniae
IVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLV

SEQ ID NO: 22307 - protein, 492 aa, Mycobacterium tuberculosis H37Rv
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFDQLEIKTILHRLLRRYRLELSRPDYQPRWDYSAMPIPMDGMPIVLRPR

SEQ ID NO: 22308 - protein, 537 aa, Medicago truncatula
MSGELGVLNALDVAKTQLYHFTTIVIAGMGFFTDAYDLFCISLVTKLLGRIYYTEPNPTRPGTLPPSAQSAVTGVALVGTLAGQLFFGWLGDKLGRKKVYGLTLILMVVCSVGSGLSFGSSPKSVMATLCFFRFWLGFGIGGDYPLSATIMSEYANKKTRGAFIAAVFAMQGFGILGGGIVALIVASIFDHKYKVPTFEENPATSLLVPQFDYVWRLILMFGALPAALTYYWRMKMPETARYTALVAKNAKQAAADMSKVLQVELEVEEEKVQKMTSDKRNSYGLFSKQFAARHGLALFGTCSTWFLLDIAFYSQNLFQKDIFSAIGWIPPAKEMNAIHEVYKIARAQTLIALCSTVPGYWFTVAFIDHMGRFAIQMMGFFFMTVFMFGLAIPYDHWSKEENRIGFVVMYSLTFFFSNFGPNAATFVVPAEIFPARLRSTCHGISAAAGKAGAIVGAFGFLYAAQSKDPTKTDKGYPTGIGIKNSLIMLGVINFVGMLCTLLVPESKGKSLEELSGENEGEGAEATEQEGPRFENVA

SEQ ID NO: 22309 - protein, 519 aa, Zea mays; identical to SEQ ID NO: 17309
  unsure (1)..(519): unsure at all Xaa locations

SEQ ID NO: 22310 - protein, 197 aa, Staphylococcus aureus subsp. aureus Mu50
MILVIDNNDSFTYNLIDYIKTQTKLTVQVVGIDNLLIEDVINMKPKAIVISPGPGNPDDYPILNEVLEQFYQRVPILGVCLGFQCIVSYFGGNIIHGYHPVHGHTTQLRHTNEGIFQGLPQNFNVMRYHSLIADGATFPNCLKITAKNDEAIIMAFEHIRFPVFGVQYHPESILSEYGYRQVELFLSKVGDYCENRI

SEQ ID NO: 22311 - protein, 491 aa, Saccharomyces cerevisiae
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 22312 - protein, 495 aa, Zea mays
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 22313 - protein, 356 aa, Neurospora crassa
MGACMSKNDEETEQKKRSQKIDRDLEEDSKKLRKECKILLLGSGESGKSTIVKQMKIIHLKGYSDEELTNYRPTVYKNLLECAKAVVNAMHQFDIQPADPSLRPYVEFLQDYNMEGCPPGQSIDPKVGTAIQALWNDPAKEQLMERQTEFYLMDSAEYFFTEVMRIVAEDYRPNEMDVLRARTKTTGIYETRFKMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKAAKYLLWRFNQVNRAHLNLYPHLTQATDTSNIRLVFAAVKETILNNALKDSGIL

SEQ ID NO: 22314 - protein, 457 aa, Glycine max
  unsure (1)..(457): unsure at all Xaa locations
MVTYAALASTRIPSNTRXPSKGSQSFPTQCASXRDLQVTEFSGLRSTSCVTYANDARESSFFDLVSSQLTPKQTNGSSTPVRGETVAKLKVAINGFGRIGRNFLRCWHGRKDSPLEVVVVNDSGGVKNASHLLKYDSMLGTFKADVKILDNETITVDGKPIKVVSSREPLKLPXGLXSWNVTCVIEXGTGVFVDGPGAGKHIQSGAKKVIITAPAKGADIPTYXVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 22315 - protein, 331 aa, Triticum aestivum
MSTRARTNPVTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 22316 - protein, 503 aa, Muscari armeniacum
MSFTDHHYLLLILFLIPILVYTIRRKISSTKSKLPPCPPKLPLIGNLHQMGTLPHQSLHALSVKYGPLMLLKLGQIPTLIVSSADMAREIMKTHDHIFASRPSLMTAGIILYGSMDVVFAPYGEHWRQMRKLCVNHLLSPKAVQSFRRMHEEEVATMVAKISEVSSSSGVVNMSETLNLFASNAMLKAISRKLFRDERRSRVICELNEETAAILGQFSVSDFMPLLAWFDMVFGVGARAKKTARLWDRVLHEIIEDCRNRRDSEVNTDFVNVLLALLEDNDMDFSLNKDIIKAVLQDMIAAGTETSSTAMDWCMAELVRNPEAMKKLQDEVRGIANTKPMITDDDLSKMGYLKAVIKELLRLHPPVPLLIPRESMDHCEVQGFDIPKQTRVIVNAWSIGRDPNVWEAPEEFRPERFLDCAINFRGHDFELIPFGAGRRICPGMQFAVSTLELALANLVRSFDWELPDGMNNEDLGMGDGPGLSARRRQSLLLVAKPFLGLKCM

SEQ ID NO: 22317 - protein, 518 aa, Oryza sativa; identical to SEQ ID NO: 14650

SEQ ID NO: 22318 - protein, 445 aa, Zea mays
MEVHADVDGSGVPLAVLLKRELCNQKVERPDILFGEANKSKKGEDFTLLLPRCHRTTGEGGGSGGGENAGDDDDDTISVFAIFDGHNGSLAAIYTRENLINNVLAAIPPNLTSEECTAALPRALVAGFVKTDKDFQTKAARSGTTVTFVIIDGWVVTVASVGDSRCILESAEGSVYFLSADHRLDANEEEVERVTASGGEVGRINIAGGAGIGPLRCWPGGLCLSRSIGDIDVGEFIVPVPHVKQVKLSNAGGRLVIASDGVWDALCFQEALNYIRGLPAEAAANRIVKEAVTSKGLRDDTTCIVVDILPPEKLSPPLKRPGKGVIKTLFRRRPSDEMSEDQMDRGCLEPDVVEEIYEEGSAMLARRLNINYPSGNMFKLHDCAVCQLEMKPGEGTSVHGNMPKHSRVDPWGGPFLCSSCQLKKEAMEGKLHSRNSQFDVRPMPK

SEQ ID NO: 22319 - protein, 183 aa, Fagus sylvatica
DGHGGSHVAMRCRDRLHDIVKEEVESVTEGMEWKDTMEKSFDRMDKEVQEWLVPIKTTNCRCDVQTPQCDAVGFTAVVAIVTPEKIIVSNCGDSRAVLCRNGVAFPLSSDHKPDRPDELVRIQDAGGRVIYWDGARVLGVLAMSRAIGDNYLKPYVISEPEVTITDRTAEDECLILASDGLWD

SEQ ID NO: 22320 - protein, 574 aa, Salmonella typhimurium
MEMLSGAEMVVRSLIDQGVKQVFGYPGGAVLDIYDALHTVGGIDHVLVRHEQAAVHMADGLARATGDVGVVLVTSGPGATNAITGIATAYMDSIPLVILSGQVATSLIGYDAFQECDMVGISRPVVKHSFLVKQTEDIPLVLKKAFWLAASGRPGPVVVDLPKDILNPAKKMPYAWPETVSMRSYNPTTSGHKGQIKRALQTLASAKKPVVYVGGGAISAACYAPLRHIIETFNLPVVSSLMGLGAFPATHRQSLGMLGMHGTYEANMTMHNADVIFAVGVRFDDRTTNNLAKYCPNATVLHIDIDPTSISKTVNADIPVVGDARLVLEQMLELLAQDAPSQPQDDIRDWWQQIESWRARQCLKYDAESESIKPQAVIETLWRLTKGDAYVTSDVGQHQMFAALYYPFDKPRRWINSGGLGTMGFGLPAALGVKMALPKEMVVCVTGDGSIQMNIQELSTALQYELPVLVLNLNNRYLGMVKQWQDMIYSGRHSQSYMQSLPDFVRLAEAYGHVGLQINRPDELESKLSEALEHVRNNRLVFVDVTVDGSEHVYPMQIRGGGMDEMWLSKTERT

SEQ ID NO: 22321 - protein, 259 aa, Zea mays
TRTCRLYDAVNVLLSLQNPNGGYGTWELARTYPWIEIFNMTEIYADIMVEHQYVECTSSVMQALVLFREKYPWHRKDEIDQCIRGATEFIEKLQNDDGSWFGSWGICFTYGTWFAIEGLSAVGQSYGNSTCIQKACKFLLAKQLKNGGWGESHLSSTTKAYTNLDKEKSHIVNTAWAMLALMKAGQFQAERDPTPLHKAARLIMSMQLSNGDFPQEEMIGSFLKNGPLCYMAYRNIFPIWALGEYQKLVLQCDLQWPTF

SEQ ID NO: 22322 - protein, 378 aa, Oryza sativa
MAQQLSAPFRAAAAAGSRASAAAADPAKVLRLRSAGSAQFTSIAASSSLNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 22323 - protein, 213 aa, Chloranthus spicatus
IENTTNRQVTFCKRRNGLLKKAYELSILCDAEVALVVFSSRGRLFEYSNNSVKTTIDRYKKAHADSNSASVSEANTQFYQQEAAKLRQQLGILQNSNRHMMGESLSSMNIKELKSLEVKLEKGISRIRSKKNELLFSEIEYMQRREMDLQNDNMYLRSKIAENERAQQHMNVLPGPEYDVMPAFDGRNFLPVNLLGSNHHQFSHQDQTALQLG

SEQ ID NO: 22324 - protein, 300 aa, Streptococcus equi subsp. zooepidemicus
MTKVRKAIIPAAGLGTRFLPATKALAKEMLPIVDKPTIQFIVEEALKAGIEEILVVTGKAKRSIEDHFDSNFELEYNLQAKGKTELLKLVDETTAINLHFIRQSHPRGLGDAVLQAKAFVGNEPFVVMLGDDLMDITNPSAKPLAKQLIEDYDCTHASTIAVMRVPHEEVSNYGVIAPQGKAVKGLYSVETFVEKPSPDEAPSDLAIIGRYLLTPEIFAILENQAPGAGNEVQLADAIDKLNKTQRVFAREFKGERYDVGDKFGFMKTSLDYALKHPQVKDDLTDYIIKLSKQLNKDVKK

SEQ ID NO: 22325 - protein, 347 aa, Citrullus lanatus
MKASILRSVRSAVSRSSSSNRLLSRSFATESVPERKVAVLGAAGGIGQPLALLMKLNPLVSKLALYDIAGTPGVAADVGHVNTRSEVTGYVGEEQLGKALEGSDVVIIPAGVPRKPGMTRDDLFNINAGIVKSLCTAIAKYCPNALINMISNPVNSTVPIAAEVFKKAGTYDEKKLFGVTTLDVVRAKTFYAGKANVPVAEVNVPVIGGHAGITILPLFSQATPRANLSDDTIVALTKRTQDGGTEVVEAKAGKGSATLSMAYAGALFADACLKGLNGVPDVVECSFVQSTVTELPFFASKVKLGKNGVESVLDLGPLSDFEKEGLEKLKPELKASIEKGIQFANAN

SEQ ID NO: 22326 - protein, 687 aa, Oceanobacillus iheyensis HTE831
MSDQDNQQEKRKQDDNKKIDQLKKFYRDNTDKIMTTDEGVKISNDENTLSAGDRGPQLLEDFMYREKLAHFDRERIPERNVHARGYGAHGVFECYESQSDLTKAHFLQKAGQQTPVFVRFSQVAGSKGANETLRDVRGFATKFYTNEGNFDLVGNNIPIFFIQDGIKFPDLIHALKPEPNNEIPQGQTAHDTFWDFIGSNEESAAMMMWIMSDRTIPRSFRTIQGFGVHTFRLVNAEGKSVFCKFHWRPVLGIHSLIWNEAQKIGGADPDFHRRDLWENIEQGFYPEYELGVQVIEEGQEFDFDFDILDATKLWPEEEVPLQMIGKMTLNKNVENVFAETEQVALHPGNIVPGIDFTNDPLLQGRLFSYTDTQIYRVGTNFKQLPINRPVCPFHNNHRDGSQRYIIDKGQVAYHQNYLAGNTPYTVPGSQGGFVTYPSLVEGLKVRKTAPSFLDHFSQARLFWNSMTDVEQSHILQAFSFELGKVNVPEVRQRVVNLIGHISRPLATAVAEQVGVEPPDKSIKQSDVTKSSPTLSLMNTKFLPNTLKVAIIVGNGYGGNALESLLESLKEVELKPYIISERLGEITADNGDTLNVDATFLTTSPVLYDGLLVVGGDHINDQFAYEAGNFITEQFNHYKPIGGMEEGATLIQQLGIANRPGVFISQSGSRQFTRQFIDGMAKQRFWDR

SEQ ID NO: 22327 - protein, 254 aa, Magnetococcus sp. MC-1
MGIWRAKLLSGNGFHCIDELERRPRIMTQLALVIDLNICVGCHACVTSCKSWNTSGWAGPLTDVNPYGEDPHGTFFNRVQTFEAGTFPDTETIHFPKSCLHCEDAPCVPVCPTEASYKREEDGIVLVDYDKCIGCKYCSWNCPYGMREFDPGEKVMKKCTLCVDRIYDVKLPEAERKPTCVMACPAGARVFGDIHDPASKASQQIRENGGFQLMPELGTQPANHYLPRRRNHAHFNEADVTRLDNPMAEEKSSL

SEQ ID NO: 22328 - protein, 445 aa, Gossypium barbadense
MAATIVSVKARQIFDSRGNPTVEVDVETSNGIKARAAVPSGASTGIYEALELRDGGSDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTKEIGEKVQIVGDDLLVTNPKRVAKAIAEKTCNALLLKVNQIGSVTESIEAVKMSKQAGWGVMASHRSGETEDTFIADLSVGLATGQIKTGAPRRSERLAKYNQLLRIEEELGAKAVYAGASFRAPVAPY

SEQ ID NO: 22329 - protein, 488 aa, Caulacanthus okamurae
TCLLCRRRTRIKNERYESGVIPYAKMGYWDPEYVVKETDILALFRVTPQPGVDPVEASAAVAGESSTATWTVVWTDLLTACDLYRAKAYRVDAVPNTSDQYFAFIAYDIDLFEEGSIANLTASIIGNVFGFKAVKALRLEDMRIPVAYLKTFQGPATGVVSERERMDKFGRPFLGATVKPKLGLSGKNYGRVVYEGLKGGLDFLKDDENINSQPFMRWKERYLYSMEGVNRSIAATGEVKGHYLNVTAATMEDMYERAEFAKQLGSIIIMIDLVIGYTAIQSMGIWARKNDMILHLHRAGNSTYSRQKIHGMNFRVICKWMRMAGVDHIHAGTVVGKLEGDPLMIRGFYNTLLLPYLEVNLPQGIFFEQDWASLRKVTPVASGGIHCGQMHQLLDYLGNDVVLQFGGGTIGHPDGIQAGATANRVALEAMVIARNEGRDYVAEGPQILQDAAKTCGPLQTALDLWKDITFNYTSTDTADFVETPTANV

SEQ ID NO: 22330 - protein, 358 aa, Vibrio parahaemolyticus RIMD 2210633
MSKIFDFVKPGVISGDDVQKVFEVAKENHFALPAVNCVGTDSVNAVLEAAAKVKAPVIVQFSNGGAAFFAGKGLKLEGQEAQILGAVAGAKYVHAVAEAYGVPVILHTDHAAKKLLPWIDGLLDAGEEYFAQTGKPLFSSHMIDLSEESLEENIEISAKYLERMAKMNMTLEIELGCTGGEEDGVDNSDMDASELYTSPEDVAYAYEKLNAISHRFTIAASFGNVHGVYKPGNVVLTPTILRDSQAYVSEKFGLPANSLNFVFHGGSGSSLEEIRESIGYGVIKMNIDTDTQWATWDGIRQYEAENHDYLQGQIGNPTGEDAPNKKYYDPRVWLRAGQASMVTRLEQAFADLNAIDVL

SEQ ID NO: 22331 - protein, 294 aa, Haemophilus somnus 2336
MSYTKELDTLNHHMVDINGKINVSFEFFPPKNEKMETLLWDSIHRLKVLKPKFVSVTYGANSGERDRTHTVVKRIKQETGLEAAPHLTGIDATPEELKAIAKDYWDGGIRRIVALRGDEPKGYIKKPFYASDLVELLRSVADFDISVAAYPEVHPEAKSAQADLINLKRKIDAGANLVITQFFFDVDSYLRFRDRCASIGIDAEIVPGILPVTNFKQLQKMAAITNVKIPSWMAKMYEGLDDDQTTRNLVAASIAMDMVKVLSCEGVKDFHFYTLNRSELSYAICHTLGVRPSL

SEQ ID NO: 22332 - protein, 564 aa, Pyrococcus furiosus DSM 3638
MEMSGAKALVRALEKEGVQHTFGIIGGSIMPVFDELLDSNIRHITTRHEQGAAHAADGYARVSGRPGVAITTSGPGATNLVTGIATAYMDSSPIVALTGQVPTYMVGKMAFQETDIINITKPITKWNYQVKRPREIPEAVKMAFTIATLGRPGPTLIDLPKDAQTDVEDVDFDVDISQKVTPWRPPKLDACPEEVKKAVDMILSAERPVIIVGGGVVWSGATDEVLAIAEYLLIPIMATFMGKGAVPENHPLYVGNLGMHGKIAANKLLPQTDLIIAVGMRWSDRTVSEFENFAPEAKIIHIDIDPKEVGKNVKVDLGIIGDAKRVLRAIYNEIVRRAKKRESWPWLEKVREFKEKYKEELVPIDGDYLRPPEILKELRKLLPPDAIVATEVGQNQMWVALFFPILKPRTFLTSGGLGTMGFGFPAAIGAKVAKPEKVVVDIAGDGSFMMSERELATAVNENLPVIVIILNNSSLGMVAQWQRMFYNRRYIATYFKKNPDFVKLAEAYGANGYKAETMDELLKAVKEGMNSDVPTVIDVPIHPEDDVLPMVPPGQHISNVVTRY

SEQ ID NO: 22333 - protein, 484 aa, Oceanobacillus iheyensis HTE831
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 22334 - protein, 457 aa, Sphacelaria rigidula
  unsure (1)..(457): unsure at all Xaa locations
DYNVKDTDVLALFRITPQPGVDPVEAAAAVAGESSTATWTVVWTDLLTACDIYRAKAYRVDPVPGTSDQYFAYIAYECDLFEEGSLANLTASIIGNVFGFKAVKALRLEDMRIPFAYLKTFQGPATGLIVERERLDKFGRPFLGATVKPKLGLSGKNYGRVVYEGLRGGLDFLKDDENINSQPFMRWKERFLYCMEGVNRAAAATGEVKGSYLNITAATIENMYERAEFAEEVGTVICMIDLVIGYTAIQTMAIWARKAQLILHLHGAGNSTYARQKNHGINFRVICKWMRMCGVDHIHAGTVVGKLEGDPLMVRGFYNTLLLTELKVNLAEGLFFDMDWASLRKCVPVASGGIHCGQMHQLLYYLGDDVVLQFGGGTIGHPDGIQSGATANRVALEAMXLARNXERDYVSEGREILRAAASXCGPLKAALDLWKDITFEYTSTDTPDFVEVATEAK

SEQ ID NO: 22335 - protein, 604 aa, Chloroflexus aurantiacus
RRVTMKPTPAGEAIQISNGRLQVPDHPIIPFVEGDGTGRDIWRASVRVFDAAVALAYGGKRKIEWLEVLAGEKAFHETGNWLPDETIETFQKYLVGIKGPLTTPVGGGIRSLNVALRKHLDLYVCQRPVRHFAGVPSPVKHPEKVDMVIFRENTEDVYTGIEYRGGSEEAAKIIAFLQREFPKDFDKIRFGTPEKTDEFRQLIGEEPEGKIEVGIGIKPISRIGTERIMAAAIQYAITYKRKSITLMHKGNIQKFTEGAFRDWAYEYAERAFGDYVYTWAQWERTKAARGEAAANAEQKEALAAGKILVKDAIADIIFQQVLTRPDEFDVIVAPNLNGDYLSDALAAQVGGIGIAPGGNINYVTGHAIFEATHGTAPKYADLDKVNPGSVILSGEMMLRYMGWTEAADLIIAGLERTIADKTVTYDFARLMEGAREVKTSEFASLIIANMEKIVAGDVPHPTPTFGPEILRRADGRVYPHGSVGAVMTRAVVAVPAEASLRETSIYMRGRGIHSVIVKPDASGEWGIMTMRDVLKKVVREGRAIDGLTVGDLTSRPLLSVSPDTPITECAALMVERNIRRLAVFENGEPVGIISETDIFSHVAE

SEQ ID NO: 22336 - protein, 327 aa, Burkholderia fungorum
MSNTGAALDVITYGEAMAMFVAAETGRLAGVGQFAKRIAGADLNVAIGLSRLGFKVGWMSRVGNDSFGQYVRDTLTREGIDQRCVTTDERYPTGFQLKSRNDDGSDPAVEYFRRGSAASHLSLDDYAADYVLPARHLHLTGVAPAISASSRELAFHLAREMRAAGKTISFDPNLRPTLWPSRAAMVEGLNALAALADWVLPGIGEGEILTGYTQPDDIAKFYLDRGARGVIIKLGAQGAYFRTAADAALIAGQPVAKVVDTVGAGDGFAVGVVSALLEGKSLPQAVARGNRIGALAIQVIGDSEGLPGRAELDALESADATSIAAAA

SEQ ID NO: 22337 - protein, 290 aa, Actinobacillus actinomycetemcomitans
MKGIILAGGSGTRLYPITRGVSKQLLPVYDKPMIYYPLSVLMLAGVRDILIITTPEDNESFKRLLGDGSEFGVNLQYTIQPSPDGLAQAFLIGERFINGDSCCLVLGDNIFYGQNFTQMLQQAVARPYGATVFGYLVKDPGRFGVVEFDENFKAVSIEEKPVQPKSNYAVTGLYFYDNRVVDFAKQVKPSARGELEITTLNEMYLKDGSLNVQLLGRGFAWLDTGTHESLHEAASFVRTIENVQGLQVACLEEIAWRNGWLTSEQVEKLAKPMAKNEYGQYLLRIIKETG

SEQ ID NO: 22338 - protein, 508 aa, Oryza sativa (japonica cultivar-group); identical to SEQ ID NO: 20231

SEQ ID NO: 22339 - protein, 189 aa, Oryza sativa (japonica cultivar-group)
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQSNFHILVVLQSFAFPYMYQVAQIYCKYPSIE

SEQ ID NO: 22340 - protein, 204 aa, Haemophilus somnus 129PT
MRTQFSKGNNMATLLKIGLVSVSDRASQGVYQDQGIPELLEWLKSALCDPFEVESRLIPDEQTLIEKTLCELVDDCHCHLVLTTGGTGPVKRDVTPDATLAVADREMPGFGEQMRQVSLHFVPTAILSRQVGVIRRNSLILNLPGQPKAIKETLEGVKDEHGNVIVKGIFSAVPYCLQLIDGIYIDTDPNVIESFRPKSARRTL

SEQ ID NO: 22341 - protein, 168 aa, Avena clauda
VMASSATSVAPFQGLKSTAGLAVSRRSNAGLGSVSNGGRIRCMQVWPIEGIKKFETLSYLPPLSEEALLKQIDFLIRSKWVPCLEFSKVGFIFRVHGSTPGYYDGRYWTMWKLPMFGCTDASQVIKEVEEVKKEYPDAYVRIIGFDNIRQVQCVSFIAFKPPGCEESG

SEQ ID NO: 22342 - protein, 464 aa, Mastocarpus jardinii
  unsure (1)..(464): unsure at all Xaa locations
KMGYWDPDYXXXETDVLALFRVSPQPGVDPVEASAAIAGESSTATWTVVWTDLLTACDLYRAKAYKVDAVPNTSDQYFAYIAYDIDLFEEGSIANLTASIIGNVFGFKAVKALRLEDMRLPVAYLKTFQGPATGIISERERMDKFGRPFLGATVKPKLGLSGKNYGRVVYEGLKGGLDFLKDDENINSQPFMRWKERYLYSMEGVNRSVAASGEIKGHYLNITAATMEEMYERAEFAKQLGSIIIMIDLVIGYTAIQSMAIWSRKNDMILHLHRAGNSTYSRQKIHGMNFRVICKWMRMAGVDHIHAGTVVGKLEGDPLMIKGFYNTLLLPYLEVNLPQGIFFEQDWASLRKVTPVASGGIHCGQMHQLLDYLGIDVVLQFGGGTIGHPDGIQAGATANRVALESMIIARNEGRDYVAEGPQILQDAAKTCGPLQTALDLWKDITFNYTSTDTADFVETPTANV

SEQ ID NO: 22343 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGECKVFYYKMKGDYHRYLAEFSSGDAREKATNSSLEAYKTASEIATTELPPTHPIRLFLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 22344 - protein, 105 aa, Triticum aestivum
  unsure (1)..(105): unsure at all Xaa locations
ASRTREADSKDLAYXKRKVVAGADVIATQLNYATDIYLKKANDWRAIGITXPIVAAITPIDNXYKAIGRMTGFLKNRIPAEITGALGPMKDKDEADPECRVHLGA

SEQ ID NO: 22345 - protein, 253 aa, Glycine max
LGHVIDKLSVSFGLEILKVVPGYVSTEVDARLSFDTAATIARAHRIIDLYEKAGIKKDRVLIKIASTWEGIQACKHLQKEGISCNMTLLFGFAQAVGCAEAGATLISPFVGRILDWHKAKTGKSSYESHEDPGVVSVTKIYQYYKKYDYKTIVMGASFRNTGEITELAGCDRLTISPGLLEELAKSTSKLDKKLDPETAAKAYTGEKVSYDEKGFRLSMNEDAMATEKLAEGIRGFSADIVKLEQILKAKLSA

SEQ ID NO: 22346 - protein, 542 aa, Shigella flexneri 2a str. 2457T
MIAVVKLLPTGEDFASHVYPCYTSHRKETIMTNNPPSAQIKPGEYGFPIKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 22347 - protein, 452 aa, Medicago sativa
MKEVAPGTQDQKQPLRANSKRALSDVTYLPHKKRAILQDVTNNCGVNTKRSCLNPTEIQAKKRKVAKPAQPHVSNEVPSAAELPPFIADSKPVSSMEMRLRSSEDFRCLDDLEDNAPFRMSSNQCGTNNNLLQSQTSRISARPLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLSLTVYLIDWFLSKNCIERERLQLLGITCMLIATKYEEINAPRIKDFCFIQDNTYTKEEVVKLESLVLKSSSYQLFAPTTKTFLRRFLRAAQASYKRPSIELEYLANYLAELTLMNYGFLNFLPSMVAASSVFLARWTLDQSSHPWNPTLEHYASYKASDLKATVLALQDLQLNSNDDCPLTTIRKKYTQDKLNCVAALSSPKLLETLF

SEQ ID NO: 22348 - protein, 552 aa, Xylella fastidiosa 9a5c
MKALFRACRIGKVMLRYRLDTLLDGTAAERWLRLAKPFVPRISAEIVEQSRGRRLRLALQELGPIFVKFGQILSTRRDLVPQDIGDELVMLQDRVEPFEGQTARIIIETALGKSVESAFAHFDTVPLASASISQVHAATLHDGREVVVKVLRPDIEHQISDDIALLKSLATLVEHTHPNADKIRPCEIVAEIETTLAAELDLQREGANASVLRRFWEASDDIYVPEVIWSHTAEQVLTLERMYGIPSDDIALLDASGIDRKALSSKGIRVFYTQVFRDNFFHADAHSGNIWVDSDPARKSNPRFIALDFGIMGQLSQKDQYYLAENFMAIFHKDYRRIAELHVEAGWIPPHVRIEELEAAARSVCEPYFTRPLSQISLAEVLMKLFHVARRYQLTLQPQLILLQKTLLNIEGVGRQLDPELDIWVVARPVLERILRARYSPRHALKELNKRLPEIMTHAPDTPRLIHTWLVQQVESRKQNDVYLQQIRALAMTLQGLQRRVVNAIVGSGLLVAAAVLYGLHPDGLYLGAIPVWSLISGCVGALALFSAWWRS

SEQ ID NO: 22349 - protein, 242 aa, Clostridium thermocellum
MKNRVISLLMASLLLVLSVIVAPFYKAEAATVVNTPFVAVFRSNFDSVQWKKRWAKFVSTVLEAFTGDISNGKMILTLDREYGGSYPYKSGEYRTKSFFGYGYYEVRMKAAKNVGIVSSFFTYTGPSDNNPWDEIDIEFLGKDTTKVQFNWYKNGVGGNEYLHNLGFDASQDFHTYGFEWRPDYIDFYVDGKKVYRGTRNIPVTPGKIMMNLWPGIGVDEWLGRYDGRTPLQAEYGICKILS

SEQ ID NO: 22350 - protein, 358 aa, Oceanobacillus iheyensis HTE831
MKRNMQEEFPMIRIMDQNGKITDTSYLEQIDKALVQQFYRQLICMRAFDQKAINLQRQGRIGTYPGFEGQEGAQVGSALALDEDDWMLPTYRDHAASITFGKSYTILSSWNGRVEGNLPPEGKNILPPSVPIATQLPLAAGIAMANKYKNSSQAVIAYFGDGATSEGDFHEGLNFASVFQAPVVFFNQNNQYAISTPISRQMNSETIVQKSVAYEIPGIRIDGNDIFAAYFETKKALERARNGEGPSLIEAVTWRYGAHTTADDPTKYRNQKEENEKHRQNDPITRLELFMKAYGFWDEAVVEQLKEEVKEEIDGAVKDLETMPPADVNDIYDYMFEKPTWTIEQQKEEYIKHLRGVK

SEQ ID NO: 22351 - protein, 178 aa, Zea mays; identical to SEQ ID NO: 7955

SEQ ID NO: 22352 - protein, 246 aa, Petunia x hybrida
MGRGRVELKKIENKINRQVTFAKRRNGLLKKAYELSVLCEAEVALIIFSNRGKLYEFSSTSNMVKTLDRYQKCSYGTLEVNHRSVKDNNEERIYREYLKLKAKYESLQRYQRQLLGDELGPLNIDELEHLELQLDSSLKLIKSTRTQLMLDQLSDLQTKEKLWVEANKVLERKLEQIYAENNIQQSWGGGEQSGAYGQQHAQTQGFFQPLECNSTLQIGYDPATSSQITAVTSGQNVNGIIPGWML

SEQ ID NO: 22353 - protein, 653 aa, Bradyrhizobium japonicum USDA 110
MGSGMTMIPQSQDRSALEQEQFLKILSREEAMARFEAALFPRAIPSETRKLADTLGTALAEDVTAPIDVPPFDRSNVDGFAVRSADLAAAGEGAPVRLALNGETIHCGTAPRMQVATGTATPIATGGPLPRGADAVVMVEHTQPAGPDAVDVRRAASPGQFVSYAGSDIARGEALLRAGTLVGSREIGMLAACGIAEVAVARKPRVAVISTGDELVQPGEVLAPAEIHDTNGAIVAAAIDENGGEAIFLGAIPDDEAKLESAMRRALADADMLVLSGGTSKGAGDLSHRIISRLGQPGVVAHGVALKPGKPLCLAVCDGKPVVILPGFPTSAMFTFHDMIVPVLRRMAGLPPRSDAKVSATVPVRIASELGRTEFVMVSLVEGRGGLIAYPSGKGSGAITSFAQADGFLRIDALADQMPAGTEAEVTLFTPHVRVPDLVIVGSHCTGLDLVTAQLAHAGLTVRSIAVGSLGGLAAAKRGECDLAPIHLFDDRSETYNTPYLVEGLELVPGWRRMQGIVFRKGDKRFEGLSAKDAVAAALTDPACIMVNRNQGAGTRILIDRLLGGARPEGYWNQPRSHNAVAAAVAQQRADWGMTIAPVAHAVGLGFIPLAEEHYDFALVTARKQRPAVQAFLDALGSGEARTALERAGFRPA

SEQ ID NO: 22354 - protein, 425 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASSSS

SEQ ID NO: 22355 - protein, 422 aa, Zea mays
  unsure (1)..(422): unsure at all Xaa locations
MAAAAAAAAFDAYTDKNAIFRRLKAKPENKMCFDCNAKNPTWASVTYGIFLCLDCSAVHRSLGVHITFVRSTNLDSWTPDQLKMMAFGGNNRAHAFFKQHGWTDGGKVEAKYTSRAAELYRQMLNKEVAKSAITDNALPSSPVTASEASKPSDDFPEFKLSDAPAPPAENLNGKHEPKSPKAAPRSPKAATHPTFATSVKKPIGAKKVGGKTGGLGVRKLTTKPNESLYEQKPEEPKPAIPALTAPTAKGGPSLHSRFEYVDNEQSSVSRTGGSGSRVTGHVAPPKSSDFFQEYGMGNGFQKKSSNASKAQIEETDEARKKXFSNAKAISSSQFFGTQNREEKEAQLSLQKFAGSSSISSSDLFGRTNVDDSNLDLSAADLINRISFQASQDLSSLKDIAGETGKKLTSFASNFISDLDRIL

SEQ ID NO: 22356 - protein, 497 aa, Nicotiana tabacum
MKKATVGAVVVGAAVTVAVGALIVRHRMRKSSKWARARAILKEFEEKCGTPDAKLKQVADAMTVEMHAGLASEGGSKLKMLISYVDNLPTGDEEGVFYALDLGGTNFRVLRVQLGGKDGGIVHQEFTEASIPPNLMVGTSEALFDYIAAELAKFVAEEEEKFHQPPGKQRELGFTFSFPIMQTSINSGTLIRWTKGFSIDDTVGQDVVAELTKAMQRKGVDMRVSALVNDTVGTLAGGRFSNKDVSIAVILGTGTNAAYVERAQAIPKWHGPLPKSGEMVINMEWGNFRSSHLPLTEYDHAMDTDSLNPGEQIFEKICSGMYLGEILRRVLLRMSEEAAIFGDEVPPKLKNQFILRTPEMSAMHHDTSSDLRVVGDKLKDILEISNTSLKTRRLVVELCNIVATRGARLAAAGVLGIVKKMGRDTPRESGQEKIVVAMDGGLYEHYTEYRKCLENTLVELLGEEMATSIVFEHANDGSGIGAALLAASNSLYVEDKS

SEQ ID NO: 22357 - protein, 116 aa, Oryza sativa
  unsure (1)..(116): unsure at all Xaa locations
IYTREGGFELAGNTMPVLLIIHGMKLPDVMTAPEQCARTNVQDNWIIDCILXHQRHSLHMFCLVYDDVSARLNYWHMEVWGDNTYTIINTDRXPHRVKFDXXPTCDDKCLWDDEAV

SEQ ID NO: 22358 - protein, 173 aa, Bradyrhizobium japonicum USDA 110
MATETKLPVTKSPTAPAVAGETWRPFQALRNEIDQIFDDFGNGFWNRPFRSLARLERDFSKSISAPAVDVAESDKAYEITAELPGLDEKNIDIKVANGGLTIKGEKREETEEKNKDYYVSERRYGTFERYFTLPESVNADKIEATFKNGVLKVVLPKTEEAQKPAKTINVKAA

SEQ ID NO: 22359 - protein, 488 aa, Hincksia hincksiae
MPEDVQNRTRIKSERYESGVIPYAKMGYWDADYNVKETDILALFRITPQPGVDPVEAAAAVAGESSTATWTVVWTDLLTACDIYRAKAYRVDPVPGTSDQFFAYIAYECDLFEEGSLANLTASIIGNVFGFKAVKALRLEDMRIPYAYLKTFQGPATGVVVERERLDKFGRPLLGATVKPKLGLSGKNYGRVVYEGLTGGLDFLKDDENINSQPFMRWKERFLYCMEGVNRAAAATGEVKGSYLNITAATMEQMYERAEYAHAIGSVIVMIDLVIGYTAIQSMAIWARKYEMILHLHRAGNSTYARQKNHGINFRVICKWMRMCGVDHIHAGTVVGKLEGDPLMVKGFYNSLLLTHLKINLAEGLFFDMDWAALRKCVPVASGGIHCGQMHQLIYYLGDDVVLQFGGGTIGHPDGIQSGATANRVALESMVLARNEGRDYVGEGPEILRRAAATCGPLKAALDLWKDITFDYTSTDTPDFVEVATESR

SEQ ID NO: 22360 - protein, 310 aa, Staphylococcus gallinarum
GFGRIGRLAFRRIQNVEGIDVVAVNDLTDDEMLAHLLKYDTMQGRFTGEVEVEKDGFRVNGQEVKSFSEPDPSKLPWGDLDIDVVLECTGFFADKTKAEAHINAGAKKVLISAPATGDLKTIVFNTNHNELDGTETVVSGASCTTNSLAPVAKVLNDDFGLVEGLMTTIHAYTGDQNTQDAPHAKGDKRRARAAAENIIPNSTGAAKAIGKVIPEIDGKLDGGAQRVPVATGSLTELTVVLEKDVSVEDVNNAMKNASNESFGYTEDEIVSSDVVGITYGPLFDATQTRVMTVGDRQLVKVAAWYDNEMS

SEQ ID NO: 22361 - protein, 170 aa, Zea mays
  unsure (1)..(170): unsure at all Xaa locations
EQKLKVTKAIEKGNMDDARIYVENAIRKRTDHKNYLRLAXLDAVVARLDTQAKMQVIGKSMQSIVKSLDSSLATGNLQKMSETMDNFERQFVNMEVQAEFMEGAMAGSTSLSTPETEVNSLMQQVADDYGLEVSVGLPQAAAHAIPAAKDKEKVDEDDLSRRLAELKARG

SEQ ID NO: 22362 - protein, 92 aa, Glycine max
ATFTGLKSMAGLPIRKTNRVISCTASNGGRMQCMQVMSPLGTKKFETLSYMTDLDDAQSAKEVEYLFTKGWINCLEIQLEHRVLYLEHNMSP

SEQ ID NO: 22363 - protein, 360 aa, Schedonorus arundinaceus
MGSTAADMAASADEEACMFALQLASSSILPMTLKNAIELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 22364 - protein, 222 aa, Novosphingobium aromaticivorans
MPELMAPPFGLTADGFETQFGTNHLGHFAFVNRIAGLMRPGSRLVLLASSGHRFANVDLADPNFESSAYDPFVAYGRSKTANILFAVEFDRRYRSLGLRATAVHPGGIRTELDRHMGDGQLQSLVDQINADMAKEGKPPLEWKSPPQGAATTLWAGLVADADDVGGRYCEDCQVSPVVRDESIGFASPGVRPYALDAEMAKALWAKSEEWVSETFDLRSAAD

SEQ ID NO: 22365 - protein, 350 aa, Candida albicans
MSEQIPKTQKAVVFDTNGGQLVYKDYPVPTPKPNELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGELVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSELPEVFKLMEEGKILGRYVLDTSK

SEQ ID NO: 22366 - protein, 164 aa, Oryza rufipogon
MEELEGHRGEGRLPPPPPLLPFPKVSVQVYTVPSSSTAASAAAAGGARQAVAPATRDGGDGGGRAAGVLDDPVKARIVSHPRYHRLLAVFLDCHKVGCPAEAAEEIAAAARVREARQRAAAAASRMPPAPEDPELDQFMEDYCKLLVECKEELSRPLQEAEEFL

SEQ ID NO: 22367 - protein, 392 aa, SYNECHOCOCCUS SP. WH 8102
MPTSRRLEALGNGVFARTDRAKQAHRDKTGVPPLIDLSLGSTDLQPPEEILRCMAAAVTDPASSAYCLEAGTAPFQQAVAAWCQRRFGVEVDPQRQVQLLVGSQEGTAHLPLAILDPGDRALLLDPSYPSHRGGLVLAGASICSLPLFQEQDWLPDFDAIRPAVWDQLKLFVLGYPHNPTATVGNQELLDQAMARGCRHQLVIANDNPYVDLALEGEAPSLLRSPGWSEWGIEFFSLSKGWCLGGFRLAFAIGAEPLITALRQVKGVVDFNQSLALQQGAIQALTQWADWPRSLHGAYRERRDRVLSVLRGGGWSCPTPGMAMYLWLPLPADAGVRKLDDETFASHVLQRSGVALTPGSGFGEGGKGWLRMALVRPTDELEDAARRVVAAVP

SEQ ID NO: 22368 - protein, 661 aa, Brassica napus
MATDSAMFASSRRRQSPSLEAFLSPVDLSDVPLLQTLSSISSEIVSCFSNARFSFQRRNTRSLIRKVQVFAVLLQHLAPESSLDPTAVLCFKELYLLLHHSKFLLRYCAHSSKLWLLLQSPSLSSFFHDLSKDYSTLLDVFLPVDSLCLNDDVREQVQLLHMQHYVDDNNDETLRNRLYSFLDEFENGSVPNSEELRFFFFEKLAIKDPTSYREEIEFLEEQIKSHGCDLDPTRSVINGFIDITRYVMFLLFKIEDGNEIKKQRKRLISEEIENTFTTTLPKDFICSISLNLMNDPVIISTGQTYDRTSIARWIHQEGRSTCPKTGQKLVDLSFVSNLALRHLTTLWCEVTGLSHDSPKESLPKVFQTRASTEANKATLSILVQNLAHGSELAAGEIRVLTRTVTETRTLIVETGAIPYLRSLLKSQNAVAQENAVASIFNLSIDEANRSLIVEEHDCLEPIMSVLVSGLTMRAKEIAAATLYTLSSVHDYKKAIANADGCIEALALVLRNGTVRGKKDAVYALHSLWLHPDNCSLMVKRGGVSALVGALGEEAVAEKVAWVLGVMATESLGAESIGREETVVTGLMELMRCGRPRGKEKAIATLLQLCTAGGAVVTEKVVKTPALAVLTRKLLLTGTDRAKRKAVSLSKVCKGCDQNTQR

SEQ ID NO: 22369 - protein, 241 aa, Pseudomonas aeruginosa UCBPP-PA14
MQAEEVAALITPRTRAMALNSPHNPSGASLPRATWEALAELCTAHDLWMISDEVYSELLFDGEHVSPASLPGMAERTATLNSLSKSHAMTGWRVGWVVGPAALCAHLENLALCMLYGSPEFIQDAACTALEAPLPELEAMREAYRRRRDLVIECLADSPGLRPLRPDGGMFVMVDIRPTGLSAQAFADRLLDRHGVSVLAGEAFGPSAAGHIRLGLVLGAEPLREACRRIALCAAELLGQA

SEQ ID NO: 22370 - protein, 224 aa, Asparagus officinalis
MGRGRVELKRIENKINRQVTFAKRRNGLLKKAYELSVLCDAEVALVVFSTRGKLYEFCSSPSMLKTLDRYQKCSYGAPDTSVQIRENQMLQSSHQEYLKLKARVEALQRSQRNLLGEDLGPLSSKELEQLEKQLDSSLKQIRSTRTQYMLDQLGDLQRKEQMLCEANRSLRKRYAQLEEASQANQQQVWEANANAMGYSRQPSQPQGEEFFHPLECQPSLGGQC

SEQ ID NO: 22371 - protein, 585 aa, Raphanus raphanistrum
  unsure (1)..(585): unsure at all Xaa locations
TFVSRYAPDEPRKGADILVEALERQGVETVFAYPGGASMXIHQALTRSSTIRNVLPRHEQGGVFAAEGYARSSGKPGICIATSGPGATNLVSGLADAMLDXVPLVAITGQVPRRMIGTDAFQETPIVEVTRSITKHNYLVMXVDDIPRIVQEAFFLATSGRPGPVLVDVPKDIQQQLAIPNWDQPMRLPGYMSRLPQPPEVSQLRQIVRLISESKXPVLYVGGGSLNSSEELGRFVELTGXPVASTLMGLGSXPCNDEXSLQMLGMHGTVYANYSVEHSDLLLAFGVRFDDRVTGKLEAFASRAKIVHXDIDSAEIGKNKTPHVSVCGDVKLALQGMNEILENRAEELKLDFGVWRSELSEQKQKFPLSFKTFGEAIPPQYAIQVLDELTDGKAIISTGVGQHQMWAAQFYKYRKPRQWLSSSGLGAMGFGLPAAIGASVANPDAIVVDIDGDGSFIMNVQELATIRVENLPVKILLLNNQHLGMVMQLEDRFYKANRAHTYLGDPARESEIFPNMXQFAGACGIPAARVTKKXELREAIQTMLDTPGPYLLDVICPHQEHVLPMIPSGGTFKDVITEGDGRTKY

SEQ ID NO: 22372 - protein, 404 aa, Brucella melitensis 16M
MPLLPVDEALAYILNSAAPHGTEDVSLTDAGGRVTASDITAQLLQPPFDCSAMDGYALIAPEEITYPLELTVIGESAAGKRFEGTLRKGEAIRIFTGAPMPENADSIIIQEHTEREGKRLIILHGLDKGRHIRRAGLDFAPGKVVVPAGRELDAPALSLAAASGHARLPVFTRPRVAILATGDELVPPGAIPGPDQIVASNSIGIAEITRRAGGTPEDLGIIADDPARIEKAISDALEDGIDMLVTIGGASVGDRDFVHGALRNCGVALDFWKIAMRPGKPLMYGRKAVNGKTVHVLGLPGNPVSSLVCSLLFLRPLVAKLSGLALKADIRAAKLGVAMRANDHRRDFIRVTVESEPDGTLVATPFPMQDSSMLSALVCSDALLIREENAPEALPGDPCRILML

SEQ ID NO: 22373 - protein, 357 aa, Colletotrichum lagenarium
MAEFIRAQIFGTTFEITSRYSDLQPVGMGAFGLVCSARDQLTNQNVAVKKIMKPFSTPVLAKRTYRELKLLKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALSHDYLAPYHDPTDEPVAEEKFDWSFNDADLPVDTWKIMMYSEILDYHNVDASAQQIEEQFNGQ

SEQ ID NO: 22374 - protein, 486 aa, Oryza sativa; identical to SEQ ID NO: 7413

SEQ ID NO: 22375 - protein, 431 aa, Desulfovibrio desulfuricans G20
MSTIVSVWAREILDSRGNPTVEVEVSLESGHSGRAAVPSGASTGSREALELRDGDKGRYLGKGVEKAVDNVMGEIAENIVGMDALRQVAVDNALIDLDGTDNKDRLGANAMLGVSLATARAAANFIGMPLYQYLGGINSKVLPVPMMNIINGGEHAPNNLDIQEFMIMPVGAPTFSEALRMGAEIFHNLKALLAADGHVTSVGDEGGFAPNLKSHDEAFRYIMRAIETAGYIPGSEVALAIDAAASEFYKDGKYHLKGENKVLSSSEMIDWLMDFTQRYPLISIEDGMAEGDWEGWQEMTVKMGDSVQIVGDDVFVTNPDILAQGIDEGVANSILIKLNQIGTLTETLDTVEMAKGAGYTTVISHRSGETEDHFIADLAVALNAGQIKTGSLCRSDRLAKYNQLLRIEEDLDDEGIYFGPYMASHFGLGEE

SEQ ID NO: 22376 - protein, 626 aa, Oryza sativa
MFDLNIVLNDFLYEHGVSTRKKLTGTEQEAGSSPEEEAKRRGRRLRQKKTESLAGGGDDARRRVGIRRTGKWTIKSSDDVDVDIYNPTPTPLLLVVGEYIGRGDGESGKWAVLSPPLPAGFRLQIRAARRRRARSSGSYSCRLRFDAACTGERRSAWRALPDARLASSPFITSVTTPRRRGGWVCFSRRADSIRRRRRRRGRGRGRLCPVSTLPRLCVRRDLQQVPNSTQFRHELTPPPSPAALEFLSSVGLEFKYKMAMMVDPPNGMGNQGKHYYTMWQTLFEIDTKYVPIKPIGRGAYGIVCSSINRATNEKVAIKKINNVFDNRVDALRTLRELKLLRHLRHENVIALKDIMMPVHRRSFKDVYLVYELMDTDLHQIIKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAELLGRKPIFPGTECLNQLKLIVNVLGTMSEADIEFIDNPKARKYIKTLPYTPGIPLTSMYPQAHPLAIDLLQKMLVFDPSKRISVTEALEHPYMSPLYDPSANPPAQVPIDLDIDENLGVDMIREMMWQEMLHYHPEVVAGVNM

SEQ ID NO: 22377 - protein, 491 aa, Zea mays; identical to SEQ ID NO: 4490

SEQ ID NO: 22378 - protein, 503 aa, Pisum sativum
MDIPIPTRQLFINGDWKAPVLNKRIPVINPATQNIIGDIPAATKEDVDVAVAAAKTALTRNKGADWATASGAVRARYLRAIAAKVTEKKPELAKLESIDCGKPLDEAAWDIDDVAGCFEYYADLAEKLDARQKAPVSLPMDTFKSHVLREPIGVVGLITPWNYPMLMATWKVAPALAAGCAAILKPSELASLTCLELGEICKEVGLPRSVLNIVTGLGHEAGAPLASHPDVDKISFTGSSATGSKIMTTAAQLVKPVSLELGGKSPLVVFEDVDLDKAAEWAIFGCFWTNGQICSATSRLILHESIATEFLNRIVKWIKNIKISDPLEEGCRLGPVVSEGQYEKILKFVSNAKSEGATILTGGSRPEHLKKGFFIEPTIITDVTTNMQIWREEVFGPVLCVKTFSTEEEAIDLANDTVYGLGAAVISNDLERCERVTKAFKAGIVWVNCSQPCFTQAPWGGVKRSGFGRELGEWGLDNYLSVKQVTQYISEEPWGWYQPPAKL

SEQ ID NO: 22379 - protein, 335 aa, Zea mays
  unsure (1)..(335): unsure at all Xaa locations
MASSNSNSSSNPLEAMGAFFSKQVDRRKLVTTEKRALATRLSSSGDTFPGSEHRPADRKRWMAELGADKLRVHQVVWPGTHDSATNKIGVPLVTRPFAQCQSMSVYEQLAMGTRVVDVRVQEERRVCHGILATYPVDVXVLDDVTRFLGETESEVVVLEVRTEFGHEDPPEXGRXLVERLGEHLLIPQDEAVFHKTVAELLPRRVICVWKPRRSPAPGPGEPLWSAGYLRDNWIDTDLPETKFESNLKFLGQQPPVAGRGFLYRVENTVTPRPDNPVVCVWPVTRRIHGYARMFIAEVFAKGLGDKLQVFSTDFIDGDFVDACAGVTKARVDGTA

SEQ ID NO: 22380 - protein, 455 aa, Staphylococcus xylosus
GPRGPLLMQDIYFLEQMAHFDREVIPERRMHAKGSGAFGTFTVTNDITKYTCASIFAEVGKQTEMFARFSTVAGERGAGDAERDIRGFALKFYTDEGNWDLVGNNTPVFFFRDPKLFPSLNHVVKRNPKTNIKDPQANWDFWTLLPEALHQITILMTDRGIPKGFRNMHGFGSHTYSMYNDKGERFWVKFHHRTQQGIENYSAEEAEQVMAKDRDSSQRDLFNNIEQGNFPKWKMYIQVMTEEQARNHKDNPFDLTKVWYKDEYPLIEVGEFELNRNPENYFQDVEQAAFAPTNIVPGLDFSPDKMLQGRLFSYGDTQRYRLGVNHWQIPVNQPKGVGMENICPFSRDGQMRILDNNQGASTHYYPNSNGAFEDQPQYKKPALDIQGQAYEYDFREDDDNYFEQPGKLFRLLSSEEQQILFNNTANEMSPVTDALKHRHIRHCYKADPAYGQGVA

SEQ ID NO: 22381 - protein, 362 aa, Pichia angusta
MSKNIVLLPGDHVGPEVVAEAVKVLEAVSSAIGVKFNFSKHLIGGASIDAYGVPLSDEALEAAKKADAVLLGAVGGPKWGTGSVRPEQGLLKIRKELNLYANLRPCSFASDALLKLSPLKSEIVKGTDFVVVRELVGGIYFGDRKEDAGDGVASDTESYSVPEVQRITRMAAFLALQSDPPLPLWSLDKANVLASSRLWRKTVEETIKNEFPQLTVQHQLIDSAAMILVKSPTKLNGVIVTNNMFGDIISDEASVIPGSLGLLPSASLASLPDTNKAFGLYEPCHGSAPDLGPGKVNPLATILSAAMMLKLSLDLVDAGRAIEQAVKNVLDAGIMTADLGGSSSTQEVGDAVAQEVAKLLKN

SEQ ID NO: 22382 - protein, 263 aa, Oryza sativa
MAQQHSPPSPPAPPSPPPALPCDPMPPPPRHDDTTLTLSLAPPAAARPLQAMVARAKCSSPTGDAPPCTECGRQFLSWKALFGHMRCHPERHWRGITPPGGGGAGAASSTAASQFTLREREVAASLLMLSGAHPARSGAGKGKGKKRLLAPAAAAAPHHSPATCADHKCAVCHRGFATGQALGGHKRCHWPDRSCADQAISMLAVSTAGSSSTTTTSASPPPAPATAATALDLNLNLPPPLARKNLQDGGSNETLDLNLGLHR

SEQ ID NO: 22383 - protein, 318 aa, Musa acuminata
MDSFPVIDMEKLLGRERGAAMEILRDACEKWGFFEILNHGISHYLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 22384 - protein, 126 aa, Zea mays
  unsure (1)..(126): unsure at all Xaa locations
SQGWGERWETILLEGNQIGAVTQSVEAVXMSXRARGGVMASHRSGETEDTFIGGXGGGXSTGQIKTGAPCRAERLGKYNQRAXSEENXGVPGYPGQMQGPGSPVGGGEDFCSYTSLLPFVTMCRGR

SEQ ID NO: 22385 - protein, 329 aa, Zea mays
MASNSSAAFFGVRDGDQQDQIKPLISPQQQLAAALPGVAGGVPAASGQGAPPAQPPPKKKRTMPDPDAEVIALSPKTLMATNRFVCEVCNKGFQREQNLQLHRRGHNLPWKLKQKNPLQAQRRRVYLCPEPTCVHHDPARALGDLTGIKKHFCRKHGEKKWKCDKCSKRYAVQSDWKAHSKICGTREYRCDCGTLFSRRDSFITHRAFCDALAQESARLPPTSLSSLTSHLYGATSTGNMALSLSQVGSHLTSTLQDGHHHHPSAELLRLGATAGGGSSIAARLDHLLSANGASAFRPPQGPPSSASFFLNAGASVGPDFGDDVGNGPH

SEQ ID NO: 22386 - protein, 385 aa, Asclepias syriaca
MQTLVFSTTNPSAWNTHGYTIKNPPKSTAVFRRLPNVSAVASPPALRTLPPEKVQIFKSLESWATQNVLPLLKPVEKSWQPTEFLPNPAQNFDDFTKEVHALRHRTSDLPDEFLVVLVGDMITEEALPTYQSMINRLDGVKDETGACTSPWAIWTRAWTAEENRHGDLLKTYLYLSGRVDMTMIDKTIQYLLSSGMNTGTNRNPYFGFVYTSFQERATFVSHGNTARLAKERGDPVLAKICGSIASDEKRHESAYSRIVEKLVEVDPSGAMLAIGEMMRMKITMPAHLMYDGQDPNLFAHFSAVAQRLGVYTAGDYADILEFLIQRWRLEKLEGLTDDARRAQEFVCGLAPRMRRLQEKADERAKKLRTTTGVKFSWIFNKELYL

SEQ ID NO: 22387 - protein, 338 aa, Triticum aestivum
  unsure (1)..(338): unsure at all Xaa locations
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATXQKTVDGPSSKDWRGGKAASFNIIPSSTGAAKAVGKLLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 22388 - protein, 457 aa, Iris hollandica
MVGILVYVALFILSLLLFLTAAAKLHNSKSKIKNQAPSPPSLPVVGHLHLLKKPLHRSISLLSARHGPILLLRFGSRPALAVSSLPLAEECLSGKNDLAFANRAHFPHEAAPLQLLTLGSANYGPHWRMLRRISAVELLSSHRINSFSQLRSEEVHSMISTLFRESSDKELNRVELKSKLFELAMNNMMRMIFGKDLASSEGAGRFREMVKESHSLLGASTRLGDFFPFLGWMDWRARRMVLRLVRRRDEFLQSLIDAHARKMEEVEEKTMIRVLVELQKSNRESNNDEGFMLKPLIIGLLQAGTDTSSDTIEWAMSLLLNNRDKLKKARDEIDARVGKERLLRESDLPNLPYLQCVITETLRLYPAAPLLVPHESAEECTVGGYAVPQGTMLLVNAYAIRVVGIVLGTLIQCFEWERVGEEEVDMTEGSGLTLPRANPLEAICRPRQSMISVLAGL

SEQ ID NO: 22389 - protein, 182 aa, Triticum aestivum
MSDAPASPPGGGGGGGGGGSDDGGGGGGFGGVREQDRFLPIANISRIMKKAIPANGKIAKDAKETVQECVSEFISFITSEASDPGRREKRKTINGDDLLWAMATLGFEEYIEPLKVYLQKHRETEGDSKLPGKSGDVSVKKDALGPHGGASGTSAQGMGQQVAYNPGMVYMQPQYHNGDISN

SEQ ID NO: 22390 - protein, 469 aa, Yersinia pestis CO92
MSAEHVLTMLNEHEVKFVDLRFTDTKGKEQHITIPAHQVNADFFEEGKMFDGSSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHAFGKTATFMPKPMFGDNGSGMHCHMSLSKNGNNLFAGDKYGGLSEIALFYIGGIIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEAMAALNEDREFLTRGGVFTDDAIDAYIELRREEMDRVRMTPHPVEFELYYSV

SEQ ID NO: 22391 - protein, 371 aa, Candida albicans
MQHGIKRVKLSEEAKRLKLEKDQIKIKNYRQLTDEIFELRANENYSDEALIKTNELLIINPEFYTIWNYRREILINNYSSSNDKDDQIYEDILNQDLNFVLVQLKKFPKCYWIWNHRRWLLFELVKLGKVNWKYEFGVVSKLLDLDQRNFHGWHYRRFVVKNMELECKNDTTLILKINLDEFNYTTLKIQKDFSNFSAWHNRTKLIPKIYNLIQQQQQQQQKDGKIFGDLPGIELFQNPILLLKNDLEMIKTGVYMSPEDTSVWLYLYWLLTDDLFTNAFKSHQQDYMNILHEQLQLINEVNEMEKEDTGQDNVGCLKSMIFINALIQNENNKPVLTEQVKSCLKQLAKIDPLRKNKYLDQLAGNAPIFHH

SEQ ID NO: 22392 - protein, 280 aa, Thalassiosira weissflogii
PHSFPPHSVALQVLGTFILWFGWYGFNPGSTLGISGEGVPDVAALCAVTTTIAAASGSVSAMFTDMLPSRRSTGETMYDITMCMNGALSGLVGITAGCSVVEPWAAFVIGIVAGWTYIFWSALLVKLKIDDAVDAIPVHFGNGIWGCIAVGLFAEPTRTINAFGEHGHYGRFYSWGNGSADAHLLAAQVCGVLWIIGWVTVIMLPYFLILNAIGLFRVDALEEEVGLDISHHKGAAYDMSGPSADVQEKFEISRSQRKIRFPRRTLMKQPKQATLQLLDF

SEQ ID NO: 22393 - protein, 298 aa, Enterococcus faecalis V583
MKVKKAVIPAAGLGTRFLPATKAMAKEMLPIVDKPTIQFIVEEALASGIEDILIVTGKAKRPIEDHFDSNVELENNLKEKNKTDLLKLVEETTDVNLHFIRQSHPKGLGHAVLQAKAFVGNEPFVVMLGDDLMEDKVPLTKQLMDDYEQTHASTIAVMKVPHEDTSKYGIINPEKEIEKGLYNVENFVEKPKPEEAPSDLAIIGRYLLTPEIFDVLENQKPGAGNEIQLTDAIDTLNKTQRVFAREFKGERYDVGDKFGFMKTSIEYGLTHPEVKDNLREYIINLGAQLAKKEQPKEK

SEQ ID NO: 22394 - protein, 277 aa, Klebsiella pneumoniae
EIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDTYAGQDIVSNASCTTNCLAPLAKVINDNFGIVEGLMTTVHATTATQKTVDGPSHKDWRGGRGAAQNNIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDN

SEQ ID NO: 22395 - protein, 463 aa, Gracilaria sp.
MGYWDPNYVVKDTDVLALFRVSPQPGVDPIEASAAVAGESSTATWTVVWTDLLTACDLYRAKAYKVNEVPNTTDQYFAFIAYDIDLFEEGSIANLTASIIGNVFGFKAVKALRLEDMRIPVAYLKTFQGPATGLVVERERMDKFGRPFLGATVKPKLGLSGKNYGRVVYEGLRGGLDFLKDDENINSQPFMRWKERFLYSMEGVNRSIAATGEVKGHYMNVTAATMEDMYERAEFAKQLGTVIIMIDLVIGYTAIQTMAIWARKNDMILHLHRAGNSTYSRQKIHGMNFRVICKWMRMAGVDHIHAGTVVGKLEGDPLMIRGFYNTLLQTHLEVNLPQGIFFEQDWASLRKVTPVASGGIHCGQMHQLLDYLGNDVVLQFGGGTIGHPDGIQAGATANRVALEAMVLARNEGRDYVAEGPQILRDAAKTCGPLQTALDLWKDITFNYTSTDTADFVETPTANV

SEQ ID NO: 22396 - protein, 489 aa, Bacillus licheniformis
MKIKAQIGMVMNLDKCIGCHTCSVTCKNTWTNRSGAEYMYFNNVETKPGIGYPKQWEDQDKYRGGWELKKGKLQLKSGAKTARLMNLFYNPYQPTIDDYYEPWNYDYETLTNSPEKKHQPVARPKSSITGDFMNLEWGPNWEDDLAGGHITGLQDPNVKKMEESIKTEFEDVFMMYLPRICEHCINPSCVSSCPSGAMYKREEDGIVLVDQNACRSWRHCVSSCPYKKVYFNWQTNKAEKCTLCFPRLEAGLPTICSETCVGRIRYLGVMLYDADKVEEAASAENEKDLYHSQLEIFLDPNDPAVAEEAKAQGIPLEWIEAAQKSPIYKMIIDWKIALPLHPEYRTLPMVWYIPPLSPIMNMFEGKGTAQSAEDIFPAIDEMRIPIEYLANLLTAGDTHHIRTTLKKMSVMRMYMRATQTNKQIDLALIQDTGLTEEQIEDMYRLLAIAKYDDRFVIPQTHREEVADLYMEQGSCGLSFAGGPGSCQNI

SEQ ID NO: 22397 - protein, 759 aa, Arabidopsis thaliana
MWKLKIAEGGSPWLRTTNNHVGRQFWEFDPNLGTPEDLAAVEEARKSFPDNRFVQKHSADLLMRLQFSRENLISPVLPQVKIEDTDDVTEEMVETTLKRGLDFYSTIQAHDGHWPGDYGGPMFLLPGLIITLSITGALNTVLSEQHKQEMRRYLYNHQNEDGGWGLHIEGPSTMFGSVLNYVTLRLLGEGPNDGDGDMEKGRDWILKYGGATNITSWGKMWLSVLGAFEWSGNNPLPPEIWLLPYFLPIHPGRMWCHCRMVYLPMSYLYGKRFVGPITSTVLSLRKELFTVPYHEVNWNEARNLCAKEDLYYPHPLVQDILWASLHKIVEPVLMRWPGANLREKAIRTAIEHIHYEDENTRYICIGPVNKVLNMLCCWVEDPNSEAFKLHLPRIHDFLWLAEDGMKMQGYNGSQLWDTGFAIQAILATNLVEEYGPVLEKAHSFVKNSQVLEDCPGDLNYWYRHISKGAWPFSTADHGWPISDCTAEGLKAALLLSKVPKEIVGEPIDAKRLYEAVNVIISLQNADGGLATYELTRSYPWLELINPAETFGDIVIDYPYVECTSAAIQALISFRKLYPGHRKKEVDECIEKAVKFIESIQAADGSWYGSWAVCFTYGTWFGVKGLVAVGKTLKNSPHVAKACEFLLSKQQPSGGWGESYLSCQDKVYSNLDGNRSHVVNTAWAMLALIGAGQAEVDRKPLHRAARYLINAQMENGDFPQQEIMGVFNRNCMITYAAYRNIFPIWALGEYRCQVLLQQGE

SEQ ID NO: 22398 - protein, 433 aa, Burkholderia fungorum
MTTLNEFSRCVAQYDPHALPVPAAQAIVRQWAAPVTAIERVPLRDALDRVLAADIVSPIDVPAHDNSAMDGYAFNRAALAGGGAGVELAVVGKALAGHPFTGRVETTQCVRVMTGACMPAGCDTVVPQELVERAAGASSIRFAANAVAAGANRRLAGEDLARGHIALRAGRIMRASDLGLLASLGIGEISVRRRLRVAFFSTGDELRSLGEPLGPGCVYDSNRYTLFAMLRRLNIDTLDLGVVRDEPAAMEAALRSAAASADVVLTSGGVSVGEADFTRQLLQTFGDVAFWSLAMRPGRPLAFGRVWSGERPGLGLPALFFGLPGNPVAVMVTFYQIVREVLLLMSGATPQPLPVIHAVSRQAIRKRAGRTEFQRGVAEPDAHGQWHVTPTGSQSSGVLSSMSEANCFIVLGHDEGEIGEGERVAIMLFDGLI

SEQ ID NO: 22399 - protein, 211 aa, Triticum aestivum
  unsure (1)..(211): unsure at all Xaa locations
VIKTVLQAYLPQLALIVFLALLXLLMFLSKSEGIPSQSHVVRAASGKYFYFIIFNVFLGFTISSSLFSALKTIVDNPPGIIVMLVNSLPGSATFFLSXVALKFFXGYGLELSRLVPLIISHLKKKYLCKTEDEVRAAWSPRDLGYNTKVPSDMLMVTIVLCTPSLHLGFIRSRRGWXVYKNSLRSSPIQTMGLRNRSVKQHIWVQILLRTY

SEQ ID NO: 22400 - protein, 549 aa, Oryza sativa
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAAQIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 22401 - protein, 308 aa, Neocallimastix frontalis
MAQKKQQQKLGFYEDFLLAGVSATISKTAAAPLERVKLLVQNQGEMLKSGRLATPYKGIGDCFVRVAKEVGIASFWRGNGANIIRYFPTQALNIAFKERIKNALAVDKEKEGYAEWLVGNIASGGAGGALSQVFVYSLDYARTRLANDAKSANGGERQYKGLIDVYKKTYKADGITGLYRGFALSCVGIMVYRGLYFGLYDSMKPLLKNLGMEGSFAASFILGWGVTTVAGIASYPIDTIRRRMMMTSGETVKYKSSIDCAKQVMQKEGVQAFFKGCGANILRGVAGAGVLSGFDKIKEVYINWRIKN

SEQ ID NO: 22402 - protein, 335 aa, Ralstonia metallidurans
MRHHGAFTPYSLFLGVGTPRLSVTRNAIQVRHALSLRGFSAFMPRSGTAFAYPCSHFEHGATMDNLKTGTDAMFILLGAIMVLAMHAGFAFLELGTVRKKNQVNALVKILVDFAVSTISYFFIGYTVAYGVQFMSGADVLAQKSGYELVKFFFLATFAAAIPAIISGGIAERSRFNPQLAATFVLVGFVYPFFEGIAWNNRFGIQDWIASVTGAPFHDFAGSVVVHAVGGWIALPAVLLLGARRGRYQKDGRISAHPPSNIPFLALGAWVLAVGWFGFNVMSAQTVDKISGLVAINSLMAMAGGTLAAWWAGRNDPGFAYNGPWQAWSPFARART

SEQ ID NO: 22403 - protein, 177 aa, Glycine max
  unsure (1)..(177): unsure at all Xaa locations
RRKEIDXCISNAIHYIENTQXNPDGSWYGCWGICYTYGTWFAVVGLTACGKNYHNSPSLRKACKFLLSKQLPNGGWGESYLSSQNKVYTNLEGNRANLVQTSWALLSLIDAGQAEIDPTPIHRGIKLLINSQMEDGDFPQQEITGVFMRNCTLNYSSYRNIFPIWALGEYRCRVLCG

SEQ ID NO: 22404 - protein, 304 aa, Trichodesmium erythraeum IMS101
MFKNLSNINQQQLNTWVKQVLTQTKSGNLPNYIPLLAEANPNSFAILLQSIDHHIISFGDIKTKVPLMSAIKPFLLFYLLSQFGNELIFKKVGQKPSEKPFNSLEQLEFDGGWPRNPMINSGAIALSSLIPGNTAREKCNNFCSWLNSYGNCQLFLDENMLASVRSLPNQNNQNIAQKLVESGSIKDAKITLDTYNQICCLSGKIIDIANLGILLVNSPHSEWQKHCFTVKTLMTNCGLYETSNRYAMDIGIPIKSSISGIVLGLVPAKGVIVCYSPPLDQQGNSVAGLLLLELISRNLEKQYN

SEQ ID NO: 22405 - protein, 448 aa, Gastroclonium coulteri
  unsure (1)..(448): unsure at all Xaa locations
LALFRVTPQPGVDPIEASAAVAGESSTATWTVVWTDLLTACDLYRAKAYKVDAVPNSSDQYFAYIAYDIDLFEEGSIANLTASIIGNVFGFKAVKALRLEDMRLPVAYLKTFQGPATGIVVEREXXDKFGRPFLGATVKPKLGLSGKNYGRVVYEGLKXXXXXXXXXXXXXXXXFMRWKERFLYSMEAVNRSIAATGEVKGHYMNITAATMEDMYERAEFAKQLGTVIIMIDLVIGYTAIQTMAIWSRKNDMILHLHRAGNSTYSRQKSHGMNFRVICKWMRMAGVDHIHAGTVVGKLEGDPLMIKGFYDTLLLTNLDVNLPQGIFFEQDWAALRKVTPVASGGIHCGQMHQLLDYLGIDVVLQFGGGTIGHPDGIQAGATANRVALEAMVMARNEGRDYVAEGPQILLDAAKTCGPLQTALDLWKDITFNYTSTDTADFVETPTANV

SEQ ID NO: 22406 - protein, 475 aa, Arabidopsis thaliana
MDAYNNPSAVESGDAAVKSVDDDGREKRTGTFWTASAHIITAVIGSGVLSLAWAIAQLGWVAGTTVLVAFAIITYYTSTLLADCYRSPDSITGTRNYNYMGVVRSYLGGKKVQLCGVAQYVNLVGVTIGYTITASISLVAIGKSNCYHDKGHKAKCSVSNYPYMAAFGIVQIILSQLPNFHKLSFLSIIAAVMSFSYASIGIGLAIATVASGKIGKTELTGTVIGVDVTASEKVWKLFQAIGDIAFSYAFTTILIEIQDTLRSSPPENKVMKRASLVGVSTTTVFYILCGCIGYAAFGNQAPGDFLTDFGFYEPYWLIDFANACIALHLIGAYQVYAQPFFQFVEENCNKKWPQSNFINKEYSSKVPLLGKCRVNLFRLVWRTCYVVLTTFVAMIFPFFNAILGLLGAFAFWPLTVYFPVAMHIAQAKVKKYSRRWLALNLLVLVCLIVSALAAVGSIIGLINSVKSYKPFKNLD

SEQ ID NO: 22407 - protein, 240 aa, Saccharomyces cerevisiae
MADEERLKEFKEANKIVFDPNTRQVWENQNRDGTKPATTFQSEEDIKRAAPESEKDTSATSGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 22408 - protein, 414 aa, Shewanella oneidensis MR-1
MSDIRQQALDYHEFPVPGKTAVCLTKPAETSHDLALAYSPGVAEPVREIAANPENAYRYTNKGNTVAVISNGTAILGLGNLGPLASKPVMEGKALLFKHFANIDSTDIEVTHNTAQEFINTVAAIAGTFGGINLEDIKAPECFVIERELIARCNVPVFHDDQHGTAIVTAAGMINALEIQGKLISDAIFVCMGAGAAAIACMTMLVKCGANRANIYMLDTKGVIHSGRTDLNEYKALFANETDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKIAAVHAIAELAKEAVPASVLKAYPKVSSLSFGSEYVLPKPMDPRLLPRVARAVAKAAIDSGVATITTLPKYAD

SEQ ID NO: 22409 - protein, 416 aa, Zea mays
MLPSTARSPNCFLSVSANSPGGPTSNMFAVGPYANEPQLVSPPVFSTYTTEPSTAPLTPPPELAHATTPSSPDVPYARFLSSSMGIKTASKDHNMPFLSTTYSGGSGLQTSYPLYPESPCSSLISPASVTPRTGLSSPIPEQEVPPAHWKTSRSACDTPYFRASPIPEQETTAQWKTSRSACDTPYARTSPTNIFGLDSSTPRNYMLDNNFFRPAASAQFYLDQAQQTFSHNGGRVSVSREKQGADEIEAYRASFGFSADEIVQSQSYVGIPDAVDESFSISPFGNNAPATEICPFSDLPNEVQKVDKSCAYAKDDTSPKKSANQLSTDSPNKVLRLDVFKGTKGGHQSEDECIRKDGHLFRKTADEISLKPIEVRKKSLPGHSCSDAEIEYRRTRSLRDANGVLSRRSALARQLH

SEQ ID NO: 22410 - protein, 359 aa, Yersinia pestis CO92
MSKIFDFVKPGVITGDDVQKVFAVAKENNFALPAVNCVGTDSINAVLETAAKVRAPVIVQFSNGGAAFIAGKGVKTDAPQGAAILGAISGAHHVHQMAEHYGVPVILHTDHCAKKLLPWLDGLLDAGEKHFAATGKPLFSSHMIDLSEESLEENIEICSKYLTRMSKIGMTLEIELGCTGGEEDGVDNSHMDASSLYTQPQDVDYAYEKLNAISPRFTIAASFGNVHGVYKPGNVKLTPTILRDSQDYVSKKHNLPHNSLNFVFHGGSGSTAEEIKEAVSYGVVKMNIDTDTQWATWEGILNYYKKNEGYLQGQLGNPEGADKPNKKYYDPRVWLRAAQVTMITRLELAFKELNAIDVL

SEQ ID NO: 22411 - protein, 250 aa, Saccharomyces cerevisiae
MSQEEKVDAKATLKTEISNNKKNDKQELELDELVGKLSIEGTPQVSQKLSKEEKHAHQLEADSRSIFVGNITPDVTPEQIEDHFKDCGQIKRITLLYDRNTGTPKGYGYIEFESPAYREKALQLNGGELKGKKIAVSRKRTNIPGFNRHYNSQNQYFQQWQWNYPLMAYPNPDTFPYYPPYPPNQSPNQNFGYNKNNYYRSPYNNKNRTFQKKHFNSAKDSTKNIRSTSQKPVVMPSDNVKSSTQEKDSK

SEQ ID NO: 22412 - protein, 496 aa, Methanosarcina acetivorans C2A
MSEQRSVPLREHLLALKPCLHGGLIQATSEMYGIPENEILDFSANFNPLGSPFDYPKSGINFDKIISEIRAKLLEYPDNRYLEFREAAARFVCLGVKPQNIIPGNGSTEIIRLVVESVVEKGDKILLPWPTFGEYEMQCRIAGAEPVYPAQEEVNTLSDELLEEAKILFICNPNNPTGKLRSREELKVLAERCREHKTLLYVDEAFIELADPSQSVADLPADNDYVFVMRSLTKAFAIPGIRMGFGIASPAMAEILNTARLSWNLGAIANATGVAFLNIEGGIDSPYLKKAREMIQKEGETLKAKIDRIRGLEAGEVNVNFIFVDISKFMLNSSELAERLAAKGVLIRDCVSFHGLGKKYIRVAVRTEKENDRLIAALGEVITEWGREQAKNELKHVIEKASEEGIGGRKTCEYYPCHFEGQNCTFCFCPFYPCGNEKTGGKWIQSSRGGKVWSCVDCHLVHKKEIAQKILDCLMQEGDTDELVKVAWKKVMEPIL

SEQ ID NO: 22413 - protein, 317 aa, Zea mays; identical to SEQ ID NO: 3248

SEQ ID NO: 22414 - protein, 337 aa, Triticum aestivum
  unsure (1)..(337): unsure at all Xaa locations
SASTRRVLKERCRHPGTRGDRTSRLSRIVLXGRKLVAPGLPRKAGLAKLTGLAGETNVRGGRQQNXLDVLTNEVFDNTLDGGGRTCVVVXAADDISRLXDPKLQLGKYCVCLKTLEMDPPSTRAAASSNEGTLALGSHRXSNEANDTRGLVEQGTDPLGKGACITPCSHSVIRMPASFTRNPTTADFVKAIRLARAPKVLGNDXDKQDVLSNEVTDQAQGRRGNCRYPTDGSSPKSXLKYIGSMVADDHRTLLYGGIFLYPADKKSPSGKLRVMYEVFPMSFLMEEAGGQSFTGKGRSLDLIPTDIHERSPIFLGSSDDVEEIKALYAEEAKKEGSA

SEQ ID NO: 22415 - protein, 545 aa, Archaeoglobus fulgidus DSM 4304
MDAAHAVAECLKNFGVGRVYGIIGTSIVDFVDALYDYREEIRYISCRHEQVAASMADAEGRLTGFPGVSLVHAAPGTLNAAIGVANAYKDGSPMVVISGGAKRKLYGKNTMLEVDQQSVMRPITMATFRVEDAAKAQSIIAKAFSIAVRECGPVYVEFAEDVWLEESSSEDVRIEAEKPRAGDAEIESVAEMLREAKKPLILAGFGVNSEEGSELLTQLVEKTSIPVATTGNGRGALDDNHRLCLGRAGFGGGSIHADEALRNSDFLLCLGCQLTDVTTYGYNWMPSGKVVAVTLDREAGKKLNYALVSYSDAVDFLRRLIEKVEGYRAPESWLHEIEVWRKSWEQMVENAVNMEYKGFANPAKFFKKLNEALPENAVVSAGQGMHVLYPQAYVKARRPRSYLAATNHGAMGFGFPAAMTAALLGYTAIAVVGDGEFMMTVQDLETAVRESIPVKVVVVNDNSYRVLYFRQKVQKMGRVYGTLHTNPDFAELAGVFGADGVTVSSDSQIEDAIGEMLNSERPFVLDLRISPDCFAPFNPQPSVRM

SEQ ID NO: 22416 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKRYLKEGH

SEQ ID NO: 22417 - protein, 314 aa, Yersinia pestis CO92
MTSKNIAVIGECMIELSQKGTDLSRGFGGDTLNTAVYIARQVSAPDLNVHYVTALGTDSFSEEMLTAWQQENIQTDLIQRMDNKLPGLYFIETDESGERTFYYWRNDAAARFWLTSPAADDICQRLETFDYLYLSGISLAILDSASRQRLLKLLRACRAKGGKVIFDNNYRPRLWQSKEETQEAYRDMLACTDIAFLTLDDEDMLWGEKPLEQVIDRTQALGVSEIIIKRGADSCIVWVKEGSEAQQYDVPAVKLPKEDVVDTTAAGDSFSAGYLAVRLTGGNAHDAAVRGHLTASTVIQYRGAIIPLAAMPTA

SEQ ID NO: 22418 - protein, 559 aa, Zea mays
MAPCSGLWGGKAGGDAYRGTPVVVKMENPNWSISEISSPEDDDDDEDILAAAGGRRRKGARTKNAKQIRWVLLLKAHRAAGCLASLASAAVALGGAARRRVAAGRTDADADADAGVLAVAGESPVVRSGFYALIRAFLVVSLLLLAVEVAAYINGWDLAASALALPALGLESLYASWLRFRAAYVAPGIQFLTDACVVLFLVQSADRLILCLGCFYIRVKRIKPEPKSPALPDAEDPDAGYYPMVLVQIPMCNEKEVYQQSIAAVCNLDWPKSSFLVQVLDDSDDLLTQALIREEVAKWQQQGARIVYRHRVLREGYKAGNLKSAMSCSYVKDYEFVAIFDADFQPQPDFLKRTVPHFKDNDELGLVQARWSFVNKDENLLTRLQYINLCFHFEVEQQVNGVFLNFFGFNGTAGVWRIKALEDSGGWLERTTVEDMDIAVRAHLHGWKFIFLNDVECQCELPESYEAYRKQQHRWHSGPMQLFRLCLPDIIKCKVLLQYSFGLYFFLSSLLDLKTILYDTLSTCSSVVFFCHCYEHNLPCILVIIIYGSLLYGLATGCR

SEQ ID NO: 22419 - protein, 307 aa, Zea mays
MAFNYHDHALAMDPANPSFVSGGGMAGGPGWEREKAAIAAHPLYERLLEAHVACLRVATPVDQLPRIDAQIAARPPPMEAAAAAAAAGGAHSGGEELDLFMTHYVLLLCSFKEQLQQHVRVHAMEAVMACWELEQTLQSLTGASPGEGTGATMSDDEDNQVDSESNMFDGNEGSDGMGFGPLMLTEGERSLVERVRQELKHELKQGYRDKLVDIREEILRKRRAGKLPGDTASTLKAWWQAHSKWPYPTEEDKARLVQETGLQLKQINNWFINQRKRNWHNNSASSSSDKSKRKRNTAGDGNAEPAW

SEQ ID NO: 22420 - protein, 516 aa, Lycopersicon esculentum
MKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAENQRFELKAMLVDTSLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 22421 - protein, 123 aa, Microbulbifer degradans 2-40
RGGNRRRKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 22422 - protein, 427 aa, Cytophaga hutchinsonii
MSLIEEIVARQIFDSRGNPTIEVDVITENGLIGRAAVPSGASTGKHEAVELRDNDKSIYMGKSVLKAVANVNDIIAPELIGSHVFEQNLIDRLMIDLDGTANKGKLGANAILGVSLALAKAAAQEAGLPLYRYVGGVSANTLPVPMMNIINGGSHADNSIDFQEFMIMPTGAKSFTEAMRMGSEIFHNLAKVLKSKGMSTNVGDEGGFAPNIASNEDALITVIQAIEAAGYRPGEDVMIAFDAASSEFYDSETKLYHFKKSTGDKLTSSQMASYWADLVKRYPIVSIEDGMDEDDWSGWAELTKLVGDKVQLVGDDLFVTNVSRLQQGIDQGIANSILVKVNQIGSLTETISAVNLAKRNSYTSVMSHRSGETEDNTIADLAVALNCGQIKTGSCSRSDRMAKYNQLLRIEEELGEAAYFPGKNMRK

SEQ ID NO: 22423 - protein, 282 aa, Escherichia coli
ALLLKTQLPSGSKLSLYNIAPVTPGVAVDLSHIPTAVKIKGFSGEDATPALEGADVVLISAGVARKPGMDRSDLFNVNAGIVKNLVQQVAKTCPKACIGIITNPVNTTVAIAAEVLKKAGVYDKNKLFGVTTLDIIRSNTFVAELKGKQPGEVEVPVIGGHSGVTILPLLSQVPGVSFTEQEVADLTKRIQNAGTEVVEAKAGGGSATLSMGQAAARFGLSLVRALQGEQGVVECAYVEGDGQYARFFSQPLLLGKNGVEERKSIGTLSAFEQNALEGMLDT

SEQ ID NO: 22424 - protein, 221 aa, Escherichia coli
DLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYE

SEQ ID NO: 22425 - protein, 728 aa, Eremothecium gossypii
MSTPIRLPDSLPYPITIAQLGVSTGDTVEKGQRLLAYKYWDLVDVITAPGEEEAGKARKQRVDLVGTFDSPVAGTVVSLDVRVGDEFVNSQRPVVEIRQACPHDVTYGGLCVQCGQAVEDEAGAADGVEQAKLTVSHTNTHIRVSERQAASLGQSAQLKLREARKLVLVVDLDQTVIHCGVDPTIGEWSKDPNNPNYEALKDVQSFSLDEEPVLPPFYMGPKPPTRKCWYYVKLRPGLKEFFAKIAPHFELHIYTMATRAYALEIAKIIDPDGKLFGDRILSRDENGSLTQKSLERLFPMDQSMVVVIDDRGDVWNWCENLIKVVPYDFFVGIGDINSNFLPIQQNSMLHLGRRNRKKPKQEEELLTDILDTEKKLKEKINEEVKRQEDQMHRLTDEKLPDTRDIAKKLEHNASLEVQQQNRPLAELQKHMRNERLLFDDDDELPHLGNILLKVHSAYYDQLQRYNSGEDPIPDIKILMPKLKETVFEGCRFVFSGLIPLHTNIERADIVLWTNMFGASTTANLDYNTTHLITRTPGTMKARLAKSFNPAIKIVHPDWIFECLVGWERVEESPYELIVEEPVGEEYLENFKRDLAEAQKKVDPPAQDSRSSLLLLDGNGSWLDYDDDEMDEFLNEESDNEEDTEQMAPASKAPRPNGFPSGGERPAAVQSQDKPELPEKESNGKRPYQPDDAVSASKVKLQRTDAFSEEAEEEDEDDLEAELLLELGQ

SEQ ID NO: 22426 - protein, 228 aa, Zea mays
  unsure (1)..(228): unsure at all Xaa locations
MAMMVDPPNGIGNQGKHYYSMWQTLFEIDTKYVPIKPIGRGAYGIVCSSINRETNEKVAIKKIHNVFDNRVDALRTLRELKLLRHLRHENVIALKDIMMPIHRRSFKDVYLVYELMDTDLHQIIKSPQGLSNDHCQYFLFQLLRGLKYLHSAEILHRDLKPGNLLVNANCDLKICDFGLARTNSSKGQFMTEYVVTRWYRAPELLLCCDXYGTSIDVWSGWCIFAELL

SEQ ID NO: 22427 - protein, 320 aa, Streptomyces coelicolor A3(2)
MAATRPAVIALTALAPVSWGSTYAVTTEFLPPDRPLFTGLMRALPAGLLLLALARVLPRGAWWGKAAVLGVLNIGAFFPLLFLAAYRMPGGMAAVVGSVGPLLVVGLSALLLGQRPTTRSVLTGVAAASGVSLVVLEAAGALDPLGVLAALAATASMSTGTVLAGRWGRPEGVGPLALTGWQLTAGGLLLAPLALLVEGAPPALDGPAVGGYLYLALANTALAYWLWFRGIGRLSATQVTFLGPLSPLTAAVIGWAALGEALGPVQLAGTALAFGATLVGQTVPSAPRTPPVAAGAGPFSSASRNGRKDSMDLTGAALRR

SEQ ID NO: 22428 - protein, 168 aa, Glycine max
  unsure (1)..(168): unsure at all Xaa locations
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 22429 - protein, 134 aa, Zea mays
MNSRRQEQQARRTIRALLAKNGALCTGVWRCRSGGADIASRAPTMATAAVSVDEKLDKLRAEVAKLDQISENEKSGFISLVSRYLSGEAEQIEWSKIQTPTDEVVVPYDTVASPPEDLEETKKLLDKLVVLKLN

SEQ ID NO: 22430 - protein, 91 aa, Bacillus anthracis str. A2012
MVLDRNPVDYHSEIEQAAFGTGVLVDGMDFSDDKMLQGRTFSYSDTQRYRVGANYLQLPVNAPKAPVRTNQHRGQMDMRNPKESGEIRILL

SEQ ID NO: 22431 - protein, 565 aa, Bradyrhizobium japonicum USDA 110
MRHGSFSGERRQVRSSYNMAFARPCTSRHGRSSFLAAFTPFRHRCILSRPTIPPRSNPINHLTGSAAMAVSQAIPITRHPFANGSYKQMLIDGKWVDAASGKRFETHNPATGELLATVAEGDKEDIDRAVAAARRAFEGPWSKVKPFERQNLLLRLADLVEKNFDELSQLDTLDMGAPLSRTRAYRLRAVGMLRYYAGQTTAIHGETIENSLPGEIFSYTLKEPIGVVGAIIPWNGPLTATIWKIGPAIATGCTVVLKPAEEAPLTSLRIAELAMEAGIPPGVVNVVPGYGETAGAALAAHPDVDKVAFTGSHVTGQSIIRASAGNLKRVSLELGGKSPDIVFADADLDAAVPGAAMAVFANSGQICSAGTRLFVEQSIYEEFVGRVAEFGKKLQVGNGLDPNVQIGPLVSEQQLERVTGYLDIGQKEGARALAGGGRVTEGALSKGFFVSPTVFAGVQDNMRIAQEEIFGPVISAIAFKDMDELVKRANNTTFGLGSGLWTRDVSKAHAVAKSLRAGSVWVNCYQAMDPAVPFGGYKMSGYGRESGKQHVEEYLNVKAVWIKTA

SEQ ID NO: 22432 - protein, 591 aa, Desulfitobacterium hafniense
MALWGNETNDTRLTESLAAGRVRMTGAQFLAAFLAKKGVSQIYGIPGAAILPFYDAVRELNMESYNVRHEQAAIFMADGYSRATGKVGVCAATSGPGATNFLTGLYSAYSDSVPLLALTGQVPTSLIGKDSFQEAPMVEMARPVTKAAYLVEKAGDLPRILKEGWELATTGKKGPILLDLPLDVQKGLVEVDWSEFDFSPPQPPRQEIAQDTLNTILSMLYEAKTPTLLAGGGIVQGNAAELLRETAELLQIPVVSSLMGKDAFPNDHPLYGGLVGTMCQTPLGNKTILESDLIINLGGRFDGRGTGDSQRFQSGRKVVHVNLDNRELSRHISTELAVAADIRDFLEHFLAFLRDKGFIPTPQARQRILDLQEERIRLARRTKFDTLPLKPQQAIAEVREAMARDGILTLDCGISQIWATQLFEAYVPRSFLITGRAGTMGWGLGAALGAKLAYPDRQVVNLLGDASLGMSLQELATAAKHNIPVVVVVLNNSLFGLIRQQQNLLFEQRCISTDLEYENHVQGHSRGLDFVATARGMGVEAELVDGPDQIQGALARAFSQNRPYLIEVLVDPLAQCSVSLDGTLTGVLELE

SEQ ID NO: 22433 - protein, 373 aa, Zea mays
MALDTADADAPRLRLDASAAVHPLLSDDGSTAAGETAEQLDARYAPYARRDAYGTMGRGPLPAAQAVRLALAAAVLLPLRFVAGMLVLLLYYLVCRACTLFVDADGGRPRLAGWRRKAVLRSGCALSRAMLFVFGFYWIRETRRRSTNAKGLNQDQFEESQRPGAIVSNHVSYVDILYHMSASFPSFVAKESVSRLPLIGLISNCLGCIFVQRESKSSEAKGVSGAVAERIQEVCQDKNTPMMLLFPEGTTTNGDYLLPFKTGAFLAGAPVQPVILKYPYRRFSPAWDSMDGARHVLLLLCQFINHIEVVRLPVYYPSQLEKEDPKLYANNVRKLIAMEGNLVLSNIGLAEKRVYHAALTGSSLPGARHEKDD

SEQ ID NO: 22434 - protein, 336 aa, Staphylococcus epidermidis ATCC 12228
MAIKVAINGFGRIGRLAFRRIQDVEGLEVVAVNDLTDDDMLAHLLKYDTMQGRFTGEVEVIEGGFRVNGKEIKSFDEPDAGKLPWGDLDIDVVLECTGFYTDKEKAQAHIDAGAKKVLISAPAKGDVKTIVFNTNHDTLDGSETVVSGASCTTNSLAPVAKVLSDEFGLVEGFMTTIHAYTGDQNTQDAPHRKGDKRRARAAAENIIPNSTGAAKAIGKVIPEIDGKLDGGAQRVPVATGSLTELTVVLDKQDVTVDQVNSAMKQASDESFGYTEDEIVSSDIVGMTYGSLFDATQTRVMTVGDRQLVKVAAWYDNEMSYTAQLVRTLAHLAELSK

SEQ ID NO: 22435 - protein, 201 aa, Oenococcus oeni MCW
MVLFLSFLKQSMLNYLNRIHIESERKMDIDLHDYIATTPDFPEKGVMFRDINPLIGNGPAYRQAINELIDFARPLKPDIIAGPEARGFVVGSPMAYALGIGFVPARKYGKLPRKSVSSSYSLEYGKNELQMHVDSIKPGQRVFIVDDLLATGGTITATMDLVRQLGGQVVGTGFFIELADLQGRKKIMEVENVPFKSLLEY

SEQ ID NO: 22436 - protein, 394 aa, GIBBERELLA ZEAE PH-1
MSAHRPNAFNSLRMGEVIREKVQDGITGETRDLQYTQCKIVGNGSFGVVFQTKLSPSGEDAAIKRVLQDKRFKNRELQIMRIVRHPNIVQLKAFYYSNGERKDEVYLNLVQEFVPETVYRASRFFNKMKTTMPILEVKLYIYQLFRALAYIHSQGICHRDIKPQNLLLDPNSGILKLCDFGSAKILVPNEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKADANAIDLIARLLEYTPTERQSAIDAMVHPFFDELRDPNTKLPDSRHGTGQLRDLPALFDFTRHELSIAPSLNPKLVPAHIRPVLASQGLDIDHFTPLTEQEMMAKLD

SEQ ID NO: 22437 - protein, 290 aa, Arabidopsis thaliana
MAKKPKQLRNKPRKSFSTQTFTVVVLVLFVILILVGLGIFSLPSTNKTSSMPMDLTTIVQTIQERESFGDEEDGNGDRWLEVISWEPRAFVYHNFLTNEECEHLISLAKPSMMKSKVVDVKTGKSIDSRVRTSSGTFLNRGHDEIVEEIENRISDFTFIPPENGEGLQVLHYEVGQRYEPHHDYFFDEFNVRKGGQRIATVLMYLSDVDEGGETVFPAAKGNVSDVPWWDELSQCGKEGLSVLPKKRDALLFWSMKPDASLDPSSLHGGCPVIKGNKWSSTKWFHVHEYN

SEQ ID NO: 22438 - protein, 217 aa, Novosphingobium aromaticivorans
MKFFVDTADTAEIADLAATGLLDGVTTNPTLIAKAGKDFIEVTKEICGLVDGPVSAEVVALDHEGMMREAEVLRKIADNVCIKVPLTVDGLKTCKALTGEGTMVNVTLCFSANQALLAAKAGATFISPFVGRHDDNGFDGMDLIRDIRLIYDNYAFETQILVASIRHGVHVLESARIGADVITAPPAVIKGLFKHVLTDKGIEGFLADWAKTGQKIV

SEQ ID NO: 22439 - protein, 764 aa, Aspergillus fumigatus
MATSDLVDHSPRHPTKAAQLASASNVILIDNYDSFTWNVYQYLVLEGATVAVFRNDEITLEELIAKKPTQLVISPGPGHPETDAGISNAAIKYFGGKIPVFGVCMGQQCMITSFGGKVDVFGEILHGKTSILKHDGKGVYEGLPPAVEVTRYHSLAGTHATIPDCLEVTSTVPLNDGSGKDVIMGIRHKQYAVEGVQFHPESILTEHGRTMFRNFLKLTAGTWEANGKSSSGSATVNGSAPKVDKKTSILNKIYDHRRAAVAVQKLIPSQRPEDLQAAYDLNLAPPQISFPCRLRQSPYSLSLMAEIKRASPSKGMIAETACAPAQARQYAKAGASVISVLTEPEWFKGSIDDLRAVRQSLEGLPNRPAVLRKEFIFDEYQILEARLAGADTVLLIVKMLSVELLTRLYNYSRSLGMEPLVEVNTPEEMKIAVELGAEVVGVNNRDLTSFEVDLGTTSRLMDLVPESTIVCALSGISGPKDVEAYKNDGVKAILVGEALMRAPNTSAFVAELLGGNSENNSKPAPSSRLVKICGTRSEEGARAAIEAGADLVGIILVEGRKRCVSDDVALRIAQVVKSTQRPTVEPDSTSPANTFSSDFFDHSTRVLRHPTRALLVGVFQNQPLAYILDKQQKLGLDVVQLHGSEPIEWASLIPVPVIRKFALDESSIARRAYHSLPLLDSGAGGSGELLDQSHVQKVLDGDDGLRVILAGGLDTSNVVDTIRKLGDSGHKVVGVDVSSGVESDGSQDPAKIRAFVQAVKAYEA

SEQ ID NO: 22440 - protein, 222 aa, Raphanus sativus var. niger
MKKPSVTPFLITLLLAAAVCTHGKEVVKDSNGNPVKIGAKYFIQPVKSNGGGLVPAAINILPFCPLGITQTLLPYQPGLPVIFGYYPPFVGTDYIVTSTTINIQFHSDIWPVCNELSKLWAVDVSSSAAKEPAVIIGGERTAPNSLFKIEKDAGAHTYKLTTSYGTVGTTPGAWLSAPQLLVTNDEAKTLLVKFVKVDDDATKATTSSSRVEKLGLRMFPFY

SEQ ID NO: 22441 - protein, 277 aa, Triticum aestivum
AGRPPRGRGFPLWLPPELKPTTTLPLSFLPFLHRVSSQTKSHPESTSLPPILFLPLPRRLRRRESPPRPSPRPRSPPSRADLFPEPPEGGDGRPVSSRAGMQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPSVKCAICDYITNTGINTMSPAPCPRPTSNESAYNASSASVPTPQPQNVTVVVENPMTVDEKGKLVSNVVVGITPGKN

SEQ ID NO: 22442 - protein, 334 aa, Eustoma grandiflorum
MEVQRVQEIASLSKVIDTIPAEYIRSENEQPVISTVHGVVLEVPVIDLSDSDEKKIVGLVSEASKEWGIFQVVNHGIPNEVIRKLQEVGKHFFELPQEEKELIAKPEGSQSIEGYGTRLQKEVDGKKGWVDHLFHKIWPPSAINYQFWPKNPPAYREANEEYAKRLQLVVDNLFKYLSLGLDLEPNSFKDGAGGDDLVYLMKINYYPPCPRPDLALGVAHTDMSAITVLVPNEVPGLQVYKDGHWYDCKYIPNALIVHIGDQVEIMSNGKYKSVYHRTTVNKEKTRMSWPVFLEPPPDHEVGPIPKLVNEENPAKFKTKKYKDYAYCKLNKLPQ

SEQ ID NO: 22443 - protein, 419 aa, Zea mays
  unsure (1)..(419): unsure at all Xaa locations
MAAMPGGAHAAGAADPMQVDQPLPPAAAGTAHAPADAKHAGSMIEGSDPVTGHIISTTIGGKNGEPKKTISYMAERVVGTGSFGIVFQAKCLETGETVAIKKVLQDKRYKNRELQIMRSMDHCNVVSLKHCFFSTTSRDELFLNLVMEFVPESLYRVLKHYSNMNQRMPLIYVKLYTYQIFRGLAYIHTVPGVCHRDVKPQNLLVDPLTHQVKICDFGSAKMLVKGEANISYICSRYYRAPELIFGATEYTTSIDIWSAGCVLAELLLGQPLFPGESAVDQLVEIIKMDLLCXQVLGTPTREEIRCMNPNYTEFRFPQIKAHPWHKIFHKRMPPEAIDLASRLLQYSPNLRCTALEACAHPFFDDLREPHARLPNGRPFPPLFNFKQELANASPELINRLIPDHARRHLGLTLLPATGP

SEQ ID NO: 22444 - protein, 337 aa, Zea mays; identical to SEQ ID NO: 717

SEQ ID NO: 22445 - protein, 381 aa, Schizosaccharomyces pombe
MSDDSHLETKVVTDGTTGEKKTISYEPCRVLGSGSFGVVIQAKLVGTPGFIAVKRVLQDKRYKNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 22446 - protein, 753 aa, Escherichia coli O157:H7
MSQQNEKNPHQHQSPLHDSSEAKPGMDSLAPEDGSHRPAAEPTPPGAQPTASGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDLVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKVADQGEEGIVEADSADGSFMDELLTLMAAHRVWSRIPKIDKIPA

SEQ ID NO: 22447 - protein, 502 aa, GIBBERELLA ZEAE PH-1
MVSETHSLDGKSPKSDLSFENVEHLATVEHAPVVLLNEDISYGRGGIRGVIESPYIFGVAFLASMGGFSFGYDQELGAFIGCLFMPTLCDKISRKKALSIVVVIFNIGAIMQTAANSYGLLVAGRTIGGIGVGTLAMGAPIYISEIAPPNLRGTLLVLESVSCVIGVVVSFWITYGTRELAGELSFRLPFGLQMVCSTILGIGIHFFPYSPRWLALVDRSDDALTNLERLRRLPRTDPRVHQEHAGICNEVTIQKRMQEKRHPGVTGLKLEILCWADLFKKSSWHRTSIAVGVAFFQQLSGINAFIYYAPTLFQSLGQSTEMSLIMSGVFNMLQLVAVTVCFFIIDKVGRRPLAIWGGIGGGTAWGIMAVLVGVFNEKWGSNPTAGWAAVAMAFCFILIYGVSYAPLGWALPAEVFPNSSRSKGVALATATVWLFNFVVGVATPPMIESIGFGVYIFFGSWCFLAAVWAFFLVPETKGKTLEQIDEVFNDHAAQEELMILRS

SEQ ID NO: 22448 - protein, 408 aa, Glycine max
MVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 22449 - protein, 525 aa, Zea mays
  unsure (1)..(525): unsure at all Xaa locations
MLGVGTAAAVLLGAVALVLADAAARRAHWWYREAAEVVLVGGVALVVVDAAARRAHGWYREAAARLPPGEMGWPLVGGMWAFLRAFKSGKPDAFFDSRLSKSSLITINQFGRTRTGVYRSFMFSSPTVLVTTAEGCKQVLMDDDAFVTGWPKATVALVGPRSFVAMPHDEHRRIRKLTAAPINGFDALTGYLPFIDSTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRRLDDDEIIDVLVMYLNAGHESSGHITMWATVFLQENPDMFARAKAXAEQEAIMRSIPSSQQGLTLRDFRKMEYLSQVIDETLRLVNISFVSFRQATRDVFVNGYLIPKGWKVQLWYRSVHMDPHVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 22450 - protein, 382 aa, Pseudomonas aeruginosa UCBPP-PA14
MIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLALPDFSIDWQRMAEAIGPRTRLVIINTPHNPSGALISREELDRLAALIRDRDIYLISDEVYEHLVFDGVAHTSVLSHEELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAVRPDLDDVAMAEWLTREHGVAAIPVSVFYEKAPDAMRLVRFCYAKREETLRQAAEKLCAI

SEQ ID NO: 22451 - protein, 81 aa, Salmonella enterica
EQALYYIGGVIKHAKAINALANPTTNSYKRLVPGYEAPVMLAYSARNRSASIRIPVVASPKARRIEVRFPDPAANPYLCFA

SEQ ID NO: 22452 - protein, 245 aa, Hordeum vulgare subsp. spontaneum
GFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKVINDNFGIIEGLMTTVHAITATQKTVDGPSSKDWRGGRAASFNIIPSSTGAAKAVGKVLPELNGKLTGMSFRVPTVDVSVVDLTVRTEKA

SEQ ID NO: 22453 - protein, 336 aa, Oryza sativa; identical to SEQ ID NO: 19592

SEQ ID NO: 22454 - protein, 290 aa, Actinobacillus actinomycetemcomitans
MKGIILAGGSGTRLYPITRGVSKQLLPVYDKPMIYYPLSVLMLAGVRDILIITTPEDNESFKRLLGDGSEFGVNLQYAIQPSPDGLAQAFLIGERFINGDSCCLVLGDNIFYGQNFTQMLQQAVARPYGATVFGYLVKDPGRFGVVEFDENFKAVSIEEKPIQPKSNYAVTGLYFYDNRVVDFAKQVKPSARGELEITTLNEMYLKDGSLNVQLLGRGFAWLDTGTHESLHEAASFVRTIESVQGLQVACLEEIAWRNGWLTSEQVETLAGPMVKNEYGQYLLRLINEEK

SEQ ID NO: 22455 - protein, 71 aa, Glycine max
  unsure (1)..(71): unsure at all Xaa locations
LCGAAVTTVNRAGACMVSPFTGGKSMAGFPTMNTNTDITFIVSNWGRVAXMQAWPPVGQKMFETLAYLPDL

SEQ ID NO: 22456 - protein, 500 aa, Caulobacter crescentus CB15
MQSMADAETADTFGCHALVGGTPKVSFWTRRKAIDTITAGHADSHQLKKTLSWPHLVALGVGAIVGTGIYTLTGVGAGLAGPGVILSFLIAGAVCACAALCYAELSTMIPASGSAYTYSYAAMGEPVAWFVGWSLILEYTLVCAAVAVGWSAHAHGLFKMIGFPDALLAGPHQGGLINMPAVFISMAVAGLLALGTRESATVNMVLVFVKIIALIVFVVLCLPAFNLAHFTPFMPNGFQAHVPEGAAADAAKVGVMAAASLIFFAFYGFDAVSTAAEETKNPKRDLTIGIVGSMAVCTAIYMIVAAVSIGASRTEVFSKSEAPLVFILESLNHGKIAQLVALAAVIALPTVILAFMYGQSRIFFVMARDGLLPRALSKVNAKTGTPVMMTLLTGVLAAVISGLLSLKDIAELANAGTLWAFIAVGASVILLRLREPNRPRVFSTPLWPIVAPAGILGCLYLFLSLPGKTQLYFLYAHLIGAVVYLAYGMRKSVLAQQERA

SEQ ID NO: 22457 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 22458 - protein, 266 aa, Glycine max
  unsure (1)..(266): unsure at all Xaa locations
MAASLQLFQCKLARPFRSFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPLVDASTLKREVAEGVDIMLIRELTGGIYFGEPTGFGTNENGEEIGFNTEIYATHEIDRIAHFAFKVAQKRRKKLRSAVKNTVLHASVGVKKXIFVKTHAYPDVELSHMYVDNAXLP

SEQ ID NO: 22459 - protein, 225 aa, Salmonella typhimurium LT2
MKQYLIAPSILSADFARLGEDTAKALAAGADVVHFDVMDNHYVPNLTIGPMVLKSLRQYGITAPIDVHLMVKPVDRIVPDFAAAGASIITFHPEASEHVDRTLQLIKEHGCKAGLVFNPATPLSYLDYVMDKLDVILLMSVNPGFGGQSFIPQTLDKLREVRRRIDASGYDIRLEVDGGVKVNNIGEIAAAGADMFVAGSAIFDKPDYKKVIDEMRSELAKVTHG

SEQ ID NO: 22460 - protein, 312 aa, Arabidopsis halleri subsp. halleri
TLRSTGADDVYIKVICCGICHTDIHQIKNDLGMSNYPMVPGHEVVGEVVEVGSDVSKFTVGDVVGVGVIVGCCGSCKPCSSELEQYCNKRIWSYNDVYTDGKPTQGGFADTMIVNQKFVVKIPEGMAVEQAAPLLCAGVTVYSPLSHFGLMASGLKGGILGLGGVGHMGVKIAKAMGHHVTVISSSDKKKEEAMEHLGADDYVVSSDPAEMQRLADSLDYIIDTVPVFHPLEPYLACLKLDGKLILMGVINTPLQFLTPLVILGRKVISGSFIGSIKETEEVLAFCKEKGLTSTIETVKIDELNTAFERLSK

SEQ ID NO: 22461 - protein, 757 aa, Glycine max
MWKLKFAEGGNPWLRTLNNHVGRQVWEFDPKLGSPQDLLEIEKARQNFHDNRFTHKHSADLLMRMQFARENPTREVLPKVGVKDIEDVTQEIVTKTLRRAVSFHSTLQCHDGHWPGDYGGPMFLMPGLVITLSITGALNTVLTEEHRKEICRYLYNHQNKDGGWGLHIEGPSTMFGSVLSYITLRLLGEGPNDGQGEMEKARDWILGHGGATYITSWGKMWLSVLGVYEWSGNNPLPPEIWLLPYMLPFHPGRMWCHCRMVYLPMSYLYGKRFVGPISPTVLSLRKELYTVPYHDIDWDQARNLCAKEDLYYPHPLVQDILWASLHKFLEPILMHWPGKRLREKAIISALEHIHYEDENTRYICIGPVNKVLNMLCCWVEDPNSEAFKLHLPRIYDYLWIAEDGMKMQGYNGSQLWDTAFAVQAIIASNLIEEFGPTIRKAHTYIKNSQVLEDCPGDLNKWYRHISKGAWPFSTGDHGWPISDCTAEGLKAVLLLSKIAPEIVGEPIDVKRLYDSVNVILSLQNEDGGFATYELKRSYNWLEIINPAETFGDIVIDYPYVECTSAAIQALASFRKLYPGHRREEIQHCIDKATTFIEKIQASDGSWYGSWGVCFTYGAWFGVKGLIAAGRSFSNCSSIRKACEFLLSKQLPSGGWGESYLSCQNKVYSNLEGNRSHVVNTGWAMLALIDAGQAKRDSQPLHRAAAYLINSQLEDGDFPQQEIMGVFNKNCMITYAAYRNIFPIWALGEYQSQVLQSR

SEQ ID NO: 22462 - protein, 356 aa, Acetobacter pasteurianus
MSRFWSPLVHKLTPYVPGEQPKMTDLIKLNTNESPYGPSPRALEAIRAADNDTLRLYPDPEALALRKALGARIGLGPEYVFVGNGSDEVLAHAFQAFFAHGEPLLFPDVTYSFYKVYCGLYSLPFRNVPLTDDMQVNVADYAGPCSGVVVANPNAPTGIALDLADVRKLLELQPNRVVLIDEAYVDFGAESAVSLIKEYPNLLVVQTFSKSRALAGLRVGFAFGQPELIEGLVRIKDSFNSYPLDRLAQVGATAAVEDEAWLATSVQKVMASRTVLTEGLQKLGFDVLPSKANFVYTRHPNRNAAELATQLRERAIIVRHLRGERTAAWLRITVGTDQQCETLLSALRDILCSNSL

SEQ ID NO: 22463 - protein, 320 aa, Vitis vinifera
MRNPASASTSKTPCCTKVGLKRGPWTPEEDELLANYVKREGEGRWRTLPKRAGLLRCGKSCRLRWMNYLRPSVKRGQIAPDEEDLILRLHRLLGNRWSLIAGRIPGRTDNEIKNYWNTHLSKKLISQGIDPRTHKPLNPKPNPSPDVNAPVSKSIPNANPNPSSSRVGEIGSNHEVKEIESNENHKEPPNLDQYHSPLAADSNENWQSADGLVTGLQSTHGTSNDDEDDIGFCNDDTFPSFLNSLINEDVFGNHNHHQQQQQQQQLQQVQQPSNVIAPLPHPAISVQATFSSSPRTVWEPAALTSTSAPLVHDQKHSMSP

SEQ ID NO: 22464 - protein, 1961 aa, ASPERGILLUS NIDULANS FGSC A4
MSNKSIFLRSIDDPAVARQYTEHKVQTTVARFAPSGFYVASGDASGVVRVWDCVGEGITKGEYSIVNGRINDLAWDGDSQRIIAVGDGKQRYGHCITWDSGNTVGEISGHTQAINAVSIRQQRPLRAAAAGDDKNVVFYHGAPFKFNTGIRDKHTNYIYGVGFSPDGSTLVSVGADRKIWLYDGKSGEVKGQIGEGEHKGSIFAVSWSKDSRKFVTASADKTVKIWDAEAGKVTQNWNIGGEGNQNFLNQQVGVVWPPGRSDNLLISLSLSGDLNYLVEGTPEPRQIIQGHQKNITSLTAFESSSGEETLWTGSFDGRVCGWDVPTGKAETIEGDGSSSYIAGLTSTQEGAGRLYSVAWDDTIRSLDIGAKTYTGSSSKLSGQPKGIAGGGTTVLVANAESIEIHRDGQKVGDFKPNFSVTAVAAHGSIAAIGGDDSTVQICDIAGTSLTPKHDFKASRDVVSAMAFSPDGSKLAIGDSRGRVLVYKVADGSLVNDRWTAHTSRITSIAWNDNGAHIVSGALDTNIFVWSLTNPGDWLQVSNAHKEGVNGVAWIAGGSKVASAGADAAVKLRQATFILPKTGQRLKGLVQLRNSHHNSDGHRDNEERRGLLSGELPPAAEGVVRRVRGKLEEQWTLLRRFVTSEPGIGVLKCSLAYLLGSLATFVPILTALLGHQDSKHMVATITVYFHPARSQGSMFKALVCACLAFIYTAFISITMFCGGGLGFIGWTKQRLNDPLVNVACSLASLSTISVLTKEGAVQAGDLSFTKISHVLKMIIMGVSATMTVSFLIFPISARKKLRSNLTSATETMATMLALITESFLSGSEEELQTAEFVNAAAQHKKAYGQLDSLVKEAKLEHYVRGTEKEYRLEKNLVRWVQDITHNLGGLRSAASMQFQLLKQTKPFGSPQPQSIGLSHQGVDVCRSISPWSMAEDRPYLEPIDERPEDDISEPDVLRPTLSRRQTSESEASAALLPADIFAIFIDHLGPSMEIFKEIPFGPAPSYKVTVDSRFITSLDRALELYKASREEALKSIYREKDIFKVKTLEIEADLEEVAASCGHFSFSLLEFGEQLKELLAILDELQLESEERPHGRSWNWLKFWRKNDLERRRFAESSPLRNSIAIPQPSYSSSQLQNSAPEFKKPFAKTRIGYQIWRSLSVFRRDDMKFAIKVGTGAALYACPSFITSTRPIYSHWRGEWGLLSYMLVCSMTIGASNTTGYARFLGTCLGAVCAILSWYITDGNALGLAFSGLMMATWTSYIIIVKRQGPMGRFIMLTYNLSVLYAYSLTQQDGQDDQDEGGDSPVITEIALHRVVAVFSGCIWGIIITRLIWPISARKRLKDGLALLWLRLSLIWKSGPLSATHSSKQQTEFMTARDKLEVERFLAHLESLQVSARSEFQLKQAFPDAVYTNLLAHTRNMVNAFVAMNLELAKNMTASQGELAILDYTVSERRHLSSRISHLLSFMASSMKMEYPLVDNLPNVEHARDRLLARLFHYRKNWEISKSSTDEDYSLLYAYDFIVIRLDSNRLPSRLRAARRVPVSLTSPTMQQIDLAALNRAAEDSASAVPPSRNAAPTQKSKALISVSRLDLGPPYLELKSRIGANWAEYKEAITLFLLGQLNQDELSSRIDPIICADPKTEHLHNNFICAIIANLTRDLPDHGVASWVSANDKPSVVSKPTSGDAAEQRLKTEVMQLPPRDRRRIKAIPERDPHDAVRNELEEYHLAKQIKLPSQVPASAGGLNMTNWELEVRKRYVQPLASETGEFPDAESIHARMTPICYEESVVNGAGVACAEFMAIATETFVKEVLSVVFSRTRCNGPSGTINGMMKRSYKQQLEREELAFTRGEIAKDGATGLLPVEAKEARTRSALGVRDLRLSLELGSGVLSHMPLLVDQIMGGYFEDELEADRRGRTDTNGTEPTDMDEMDVDEADWGWEGATAGDHQQLGTLLDECLAMAS

SEQ ID NO: 22465 - protein, 493 aa, Cyanidium caldarium
MSQSLEEKSVQERTRIKNSRYESGVIPYAKMGYWNPDYQVKDTDVLALFRVTPQPGVDPIEAAAAVAGESSTATWTVVWTDLLTAADLYRAKAYKVDQVPNNPEQYFAYIAYELDLFEEGSIANLTASIIGNVFGFKAVKALRLEDMRLPFAYIKTFQGPATGVILERERLDKFGRPLLGCTTKPKLGLSGKNYGRVVYEALKGGLDFVKDDENINSQPFMRWRERYLFVMEAVNKAAAATGEVKGHYLNVTAATMEEMYARAQLAKELGSVIIMIDLVIGYTAIQTMAKWARDNDMILHLHRAGNSTYSRQKNHGMNFRVICKWMRMAGVDHIHAGTVVGKLEGDPIITRGFYKTLLLPKLERNLQEGLFFDMDWASLRKVMPVASGGIHAGQMHQLIHYLGEDVVLQFGGGTIGHPDGIQSGATANRVALEAMILARNENRDFLTEGPEILREAAKNCGALRTALDLWKDITFNYTSTDTSDFVETPTANI

SEQ ID NO: 22466 - protein, 355 aa, Magnaporthe grisea
MCFGSRNVHDEAGAARSRELDKAIRADEKRLQKEVKLLLLGAGESGKSTVLKQMKLIYAQGFSKNEKIEWKPVVFQHIVQSFRLIHDAMQELDIEFENKENERNITLIMEEQELGAHDALPIEFLDPIKALWVDAGVKKAIAKGNEFALHDNLDYFCDDLDRIWDKSYVPTDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKMDLFKEKITKSPITEYGFTDYHGPSDDWKQTSKYFMDKFRALNRNPEKEIYGHFTNATDTNLLKITMTSVQDMIIQRNLKQLIL

SEQ ID NO: 22467 - protein, 471 aa, Gelidium attenuatum
  unsure (1)..(471): unsure at all Xaa locations
SGVIPYAKMGYWDPDYAVKETDVLALFRVTPQPGVDPVEASRAVAGXSSTATWTVVWTDLLTACDLYRAKAYKVEEVPNSSDQYFAYISYDIDLFEEGSIANLTASIIGNVFGFKAVKALRLEDMRIPVAYLKTFQGPATGVIVERERMDKFGRPFLGATVKPKLGLSGKNYGRVVYEGLKGGLDFLKDDENINSQPFMRWKERFLYAMEGVNRSIAATGEIKGHYMNVTAATMENMYERAEFAKQLGTIIVMIDLVVGYTAIQSMAIWARKNDMILHLHRAGNSTYSGQKNDGMNFRVICKWMRMAGVDHIHAGTVVGKLEGDPLMIKGFYNTLLESHLDQNLPQGIFFEQDWASLRKVTPVASGGIHCGQMHQLLDYLGVDVVLQFGGGTIGHPDGIQAGATANRVALEAMVIARNEGRSYVEEGPQILRDAAKTCGPLQTALDLWKDISFNYTSTDTADFVETPTANG

SEQ ID NO: 22468 - protein, 901 aa, Oryza sativa; identical to SEQ ID NO: 2941

SEQ ID NO: 22469 - protein, 472 aa, Haemophilus somnus 129PT
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDVAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 22470 - protein, 372 aa, Oryza sativa
  unsure (1)..(372): unsure at all Xaa locations
MWRLKVAQGGGALLRSTNGFAGRAVWEFDPDHGTPEDRANVERVRRDFTDHRLRRPESADLLMRMQVXKQSPTPXDRIPPAVNKLGEKEQVTEETVMASLRRALDEFSSLQADDGHWPGDLSGAIFIMPVLIFSLYATGSLDTVISSEHRREICRYIYNHQNEDGGWGMLILGSSTMFATCLNYVTLRLIGEEPSNEQLARGHAWIISHGGATLVPQWGKICLSIIGVYEWSGNNPIFPELWLAPQFLPFHPGKFWGPTRVVYVPMAYLYGKKFVGPITPTILALREEIYTDPYHTIDWAQACNACSKEDLVCPRTLLQNVVWTSLYKWVEPVLGSRPMNKLRERALDRLMEHIHYEDENSQYLCLCPVNKV

SEQ ID NO: 22471 - protein, 583 aa, Schizosaccharomyces pombe
MGFKLNPFSKKPKDEEPLPLEQYEASEQKILGLVTKKEAKLLAIAGTGFLLDSYDLFIINLVSPILAYLYWGGLTGHQDYPSGIRGVVNAATNIGNIMGQLLFGFLGDFFGRKFVYGKEMMVVIIATILIICLPDRIPTPTAKMMWLFAFRVMLGIGIGGDYPMSASITSEQSLINRRGALLAWIFSNQGWGTLAGCVATLIILACFEKPLNDRGEYTKLNGVWRIQFGIALFPAVIVLIPRLRMQESEQFKNSKNMKSPGEGDLDSASQIELHDFKKKESLTAEFTTSSPSTASLSDKKNPGSVHIRPNNEVAPSSAPSRAPSTTSVESNTEGKESDIQTGSSFVSYFKEWRHAKLLIGSALSWFLLDIAFYGINLNQSVILQEMGFNKGVNEYHILQKNAIGNLIIAVAGYIPGYWVSVVLIEVMGRKWIQIQGFLICCLLFGVLAGTWETISTGGRFACVALAQFFFNFGPNTTCFVIPAEVFPSRVRAFSHGICAACGKAGAILSALLFNKLTEVIGFGNVLWIFFGCMVAGAVVTLILPETANRDADLIDRLEIAAMQQGRTSIIDRSEKWAWWKHGI

SEQ ID NO: 22472 - protein, 300 aa, Zea mays; identical to SEQ ID NO: 2533

SEQ ID NO: 22473 - protein, 215 aa, Pachysandra terminalis
GLVKKAHEISVLCDAEVALIVFSTKGKLFEYSTDSCMDQILERYERYCCAERELGAADTESQGSWTQEYTKLKSKIEVLQKNLRHLKGEDLESLRLKELQNLEQQLDNSLKHVRSRKNQLMHDSISELQKKEKELQEQNNMLNKKLKEKERAKTQQAQWEQQNQGPNSPSLQLSQPLPFLNIGGTYQTRSTRNQEEGGRPHHSNRTDALMPHWMV

SEQ ID NO: 22474 - protein, 427 aa, Coxiella burnetii RSA 493
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 22475 - protein, 249 aa, Yersinia pseudotuberculosis
MIIFVTGATSGFGEAIARKFISHGHQVIATGRRQERLEALKAELGAQLHIVRLDVRNRVAIQQVIDELPAELKNIDLLVNNAGLALGLEPAYKANVDDWDTMIDTNTKGLVNMTRALLPAMVERNMGHIINIGSTAANWPYAGGNVYGATKAFVKQFSLGLRADLHGTHIRVTDIEPGLVGGTEFSAVRFKGDGEKVNKTYDGADPLMPEDIAEAVYWVAMLPARVNINSLEMMPVSQSFAGLNIHRGS

SEQ ID NO: 22476 - protein, 421 aa, Schizosaccharomyces pombe
MAFRGIRPSNKVAASRPDVWTLVNQATAECKVPPVSLSQGFFNYNPPKFVLDAAKKSIDEVACNQYSHTRGRPSLRKALSEAYSPYFKRTLNPDTEIVVTAGANEGFFSVFAAFLNPGDEVIVMEPFFDQYISNITMNGGVPVYVPIIPPEEGSVKPVSAGAWKLDMNKLRNAITEKTKMIVINTPHNPLGKIFSEEELNEIADLVLKHNLLVVSDEVYDRLSFVPFVRLATLRPELFKHVVTVGSGGKTFGCTGWRVGWLIGDESLIKYSAAAHTRICFAVNSPCQEALAIAFGEAEKHNYYEEYKSSYKKRFEILAKAFDQLEIPYTIPDGSYYTMANFSKLKLPKDYPFPEEIANRPRDFKLCYWILKEIGVATIPPTEFYTDEDAPVAENYLRFAFCKTFETLEEAARRLQKLKDYF

SEQ ID NO: 22477 - protein, 338 aa, Xylella fastidiosa Ann-1
MSVALSIDLSKKKTILCFGEALIDMLAQPPVKKGMPRAFLQCAGGAPANVAVAVARLGGAVQFVGMLGSDMFGDFLFDSFAEAGVVTDGIVRTNTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIASTLRFAAAVGALAVTRQGAFTAMPMLSEVLSLIQEQS

SEQ ID NO: 22478 - protein, 752 aa, Cellvibrio gilvus
MHRKNHAAAAARTALVAAIAAAFPLFTPGAFAAPEPAEPAQKPWLDASLDADQRARLAVQAMTQQEKLRWVFGYFGHDFGKSKKHPDALPQSAGYIPGTPRLGLPALFETDAGQGVASQSGANVRERTALPSGLSTASTWDPKVAYAGGAMIGSEARASGFNVMLAGGVNLQREPRNGRNFEYAGEDPLLAGTMIGQAIKGVESNRIISTLKHFVLNDQETGRNELDARIDKAALRMSDLLAMELALEQSDAGSVMCAYNRLNGPYTCEHPWLLSEVLKRDWGFRGYVMSDWGATHSTVAAANSGLDQQSGQEFDKSPYFGGALEEAVKTGAVPQKRLDDMVTRIVRTMFGKGVVDNPLKPGVAIDFAANGGQPPDGEEGMVLLKNEGRLLPLAKTVRTIAVIGGHADAGVLSGGGSSQVYPVGGIAVKGLLPATWPGPVVYYPSSPLRAIQAQAPNAKVVFDDGRDPARAARVAAGADVALVFANQWIGEANDAQTLALPDGQEELITSVAGANGRTVVVLQTGGPVTMPWLARVPAVLEAWYPGTSGGEAIANVLFGAVNPSGHLPATFPQSEQQLPRPKLDGDPKNPELQFAVDYHEGAAVGYKWFDLKGHKPLFPFGHGLSYTTFAYSGLSGQLKDGRLHVRFKVTNTGNVAGKDVPQVYAAPMSTKWEAPKRLAAWSKVALLPGETKEVEVAVEPRVLAMFDEKSRTWRRPKGKIRLTLAEDASAANATSVTVELPASTLDARGRAR

SEQ ID NO: 22479 - protein, 121 aa, Zea mays
VCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLSEFRKIQQ

SEQ ID NO: 22480 - protein, 821 aa, Haemophilus influenzae Rd
MIMDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHNSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSDLMVTSTFADFARIFPERFTNVTNGITPRRWLAVANPQLAALFDKYIGSEWRCDLSQIEKLKPFAQEKAFKEAVADIKFANKVKLAEYVKSELGVELDPHALFDVQVKRIHEYKRQMLNVLHIIARYNEMLTNPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGEDNIFIFGNTVEQVEQLRREGYRSFEYYQNDAQLRTVVDQIIEGKFSPEDPQRYHQLLQGLQYHDYYQAFADFRSYVETQKAVDEKYKQRDQWIESTIQNIVNMGFFSSDRTIKEYAERIWKVEPVQLGD

SEQ ID NO: 22481 - protein, 482 aa, Pseudomonas fluorescens
MLDVPLLIGGQSCPARDGRTFERRNPVTGELVSRVAAATLEDADAAVAAAQQAFPAWAALAPNERRSRLLKAAEQLQARSGEFIEAAGETGAMANWYGFNVRLAANMLREAASMTTQVNGEVIPSDVPGSFAMALRQPCGVVLGIAPWNAPVILATRAIAMPLACGNTVVLKASELSPAVHRLIGQVLQDAGLGDGVVNVISNAPADAAQIVERLIANPAVRRVNFTGSTHVGRIVGELSARHLKPALLELGGKAPLLVLDDADLEAAVQAAAFGAYFNQGQICMSTERLIVDAKVADAFVAQLAAKVETLRAGDPADPESVLGSLVDASAGTRIKALIDDAVAKGARLVIGGQLEGSILQPTLLDGVDASMRLYREESFGPVAVVLRGEGEEALLQLANDSEFGLSAAIFSRDTGRALALAQRVESGICHINGPTVHDEAQMPFGGVKSSGYGSFGGKASIEHFTQLRWVTLQNGPRHYPI

SEQ ID NO: 22482 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 22483 - protein, 409 aa, Staphylococcus aureus subsp. aureus Mu50
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTMAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 22484 - protein, 237 aa, Pinus taeda
MGSLESEKTVTGYAARDSSGHLSLYTYNLRKKGPEDVIVKVIYCGICHSDLVQMRNEMGMSHYPMVPGHEVVGIVTEIGSEVKKFKVGEHVGVGCIVGSCRSCGNCNQSMEQYCSKRIWTYNDVNHDGTPTQGGFASSMVVDQMFVVRIPENLPLEQAAPLLCAGVTVFSPMKHFGMTEPGKKCGILGLGGVGHMGVKIAKAFGLHVTVISSSDKKKEEAMEVLGADAYLVSKDTEK

SEQ ID NO: 22485 - protein, 226 aa, Zea mays
LGTSRPAAAASVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPEGKKIILNFVRFIEELEKQRS

SEQ ID NO: 22486 - protein, 335 aa, Bacillus megaterium
MAVKIGINGFGRIGRNVFRAALKNDNVEVVAINDLTDANMLAHLLKYDSVHGKLDAEVVVDGSNLVVNGKTIEISAERDPAQLSWGKQGVEIVVESTGFFTKRADAAKHLEAGAKKVIISAPASDEDITIVMGVNEDKYDAANHNVISNASCTTNCLAPFAKVLNDKFGLKRGMMTTVHSYTNDQQILDLPHKDYRRARAAAENIIPTSTGAAKAVSLVLPELKGKLNGGAMRVPTPNVSLVDLVAELDKEVTVEDVNNALKEAAEGDLKGILGYSEEPLVSGDYNGNINSSTIDALSTMVMEGNMVKVISWYDNESGYSNRVVDLAQYIAAKGL

SEQ ID NO: 22487 - protein, 359 aa, Streptomyces avermitilis MA-4680
MSCRTGTDTVPAGSHEQRTVESGEVMAKETTPRGGGVWAAADLLTPMAVRVAATLRLADHIAAGARTTEALAEAVGADRDALGRLLDHLVTAGVLSGTGPGAYDLTAMGRHLCEGAPEDMRAILDIEGALGHAELSLVHLLHTVRTGEAAFPQQYGVTFWDDLSSDDGRAESFDTLMGARLTAHSPAVAGAYPWGTLRHVVDVGGGDGTMLIAILQSHPDLRGTVVDLPGPVRRAEKAIAAAGLDHRADIAAGSFFDALPAGADGYLLSSILHNWDDASAARILRRCADAAQTTGRVLVVDYFGDRTVQTEGDLRMLGYFGGRQHTLEQLAELAGTVGLHTTSVTPAGRYSVVELRAVG

SEQ ID NO: 22488 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 22489 - protein, 180 aa, Petunia x hybrida
MASSVISSAAVATRTNVAQASMVAPFNGLKSAVSFPVSSKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGF

SEQ ID NO: 22490 - protein, 476 aa, Zea mays
MAQPHLVLPSPRPLLPAAATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTQNKSKLGANAILGVSLSVCRAGAGAKGVPLYKHIQELAGIKEPVMPVPAFNVINGGSHAGNNLAMQEFMLLPVGAATFAEALRMGSEVYHVLKGIIKAKYGQDACNVGDEGGFAPNVQDNREGLVLLMDAIEKAGYTGMIKIGMDVAASEFLTKDGNYDLNFKNQPNDGVHVLSAQHLGDLYRDFVKDFPIVSIEDPFDQDDWSSWASLQSSVGIQIVGDDLLVTNPKRIADAIDRKACNALLLKVNQIGTVTESIQAALDSKAAGWGVMVSHRSGETEDNFIADLAVGLASGQIKTGAPCRSERLAKYNQLLRIEEGLGNVRYAGEAFRSP

SEQ ID NO: 22491 - protein, 235 aa, Brassica rapa
MALETLNSPTSATASARPLLRYREEMEPENLEQWAKRKRTKRQRFDQSRLNQETAPSEEEYLALCLLMLARGSAVQSPLPPSSSSDHRGYKCTVCGKSFSSYQALGGHKTSHRKPASNVNVPINQEQSNNSHSNSNGGSVVINGNGVSQSGKIHTCSICFKSFSSGQALGGHKRCHYDAGNNGNGNGSSSNSVEVVGGSDGSYVDDERSSEQSATGDNRGFDLNLPADQVAVVIS

SEQ ID NO: 22492 - protein, 1175 aa, GIBBERELLA ZEAE PH-1
MASAYNVRITTSQTTPHRTISSLIMTSSLSIEEFLEPLSVDIDKIEQLSQNFLETFEKLASDSENQGGTNLRVGFVQLGNDASSATSDQLNGHVGNGPDEGATTRQVRRLLEKSWPIDEHLKNENPDSLFLWIGQCIAEVVQDGCKTLQLKADQPMPLGVTFSFPMVQHSISQATLMPMGKGFAISSDQDLGGRLTDGYNRAKSPDLPPIRVEAIANDSVSTLVSFIFNFHEASNRRACMGLILGTGCNATIPLKLSQLSPSKRPPSVVARPEERAEDVNIAINTEWSINGTAPPLYDVGLVTRWDRALDQQGELNSFQPLEYLTSGRYLGELGRLMLVDYLTEHLGIAAGTLPKALLQRHNLTTTYLSHFKPLQPSTLMTSLQQEFPESSGSPPFEWTEEIATALYRIAKAIEVRAAGIVAAATLALLTLAGDVPMDGAHALDRDCELGVGYTGGCIVHFQNYLQDCQDFLDELLSKRFGDESPLRVRQELFSRDSLGLLGFQQPLQFNHLQVACADDSSYLRGGYSIVVMSPQKTSPVSDAPTTRPVPVPVRTNSRGSESDQDVVDPTAYEALSRSFTTGAHFLQPESLESAMLRPSSYKASLHLHRGVDEEDQGAVTEGDDESEISTDLDDEGPNEETPLVRHQSRRLSLTGRSTISVDVTPSPFLNNTSPTRFWFIFSQILAAYFISCFDGTIMASSHPVVSSYFNASNSASWFSTAFLLTSSAFQPLLGRLSDALGRKPLFVGAMGIFAASITWSSLAGSIESFILSRAFCGIGAGGVMTLGSIIVSDLVPIENRGAYQSYINMNYGVGSSLGAATGGAIADSLGWRWEFGIQVPPLLICMVVAWIAIPDDLGIQGQRKSVWQALREFDFRGSLLLTTAITSVILGLTLGGNVMPWSHPIVIASLVLFAITFPLFIWVESWVHKPIMPLHLIYKAPRANLVASNAIAALIANSILFNIPLYFQAVLLTTATSSGLRLIIPTIAASATGTFTGFAVTYTGRLKWPVQIGTICTLIGTIGLASLQRDLPSWVYLFILMPSSIGQGFQFPGTFMAILAASDQSEQAVVTSTLMLWRSLGQVLGVASSSLVVQNALFHYLKQFVTGEDRDEIIRHVRESVEEIIKLEPKYREQVILSYEAALRLTFICCIVVALASALIVVPIKLPRLGVRKHK

SEQ ID NO: 22493 - protein, 491 aa, Musa acuminata
GTRRDRERERERERERERERERERERERERERERERVHLLGSSSLHRSLWELSKKHGPLMHLKFGRVPVVVVSSPEMAKEVLKTHDLECCSRPSLLSFSKFSYGLSDVAFIPYGERWRQLRKLCTVELLSTRKINSFRDIRKEEMERVTKLICSHVRASSMVNLSELLLSLSCNMTCRSAFGSGFDDGGDIQLHDMLREAQEELSGLFLSDYLPLLGWVDRLSGMRSRLERAFLKLDSIYQRRIDYHQDRLRQQGKEDGDVLDALLRMQKDEEGLTEDHIKGVLMDIFIAGTDTSSATVEWAMAELIRQPELMKRAQDEVRRCVGSKGEVEESDLHQLHFFKCVIKETMRLHPPAPLLLPRETMQHFKLNGYDILPKTWMYVNAWAIGRDPNSWGRPHVFDPERFMHDSTEASGQDFKLIPFGEGRRICPGKNLGMLMVELVLANLLYSFDWHLPPGMVKEDISMEEAPGVPVHREYALCLMATKYDATTA

SEQ ID NO: 22494 - protein, 329 aa, Methanothermobacter thermautotrophicus str. Delta H
MKSMKIAVIPGDGIGVEVMEAALHILNTLDLDLEFIHADAGDACLKRTGTALPEETLEAVGEARATLFGAAGESAADVIVRLRREFDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEATDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLAEGLVTPDLGGKLGTMEMAAEIARHLED

SEQ ID NO: 22495 - protein, 184 aa, Ferroplasma acidarmanus
MSEMEKITIENIVASTSLAEHLDLSRIALALEGSEYEPEQFPGLIYRLKDPKTAVLIFRSGKVNCTGAKNLENVKKTIDIIIDKLKKAKIEVYDNPDIIVQNIVAVYDLESDLNLTDIAMSLGLENVEYEPEQFPGLVYRVEEPKVVLLLFGSGKVVCTGAKEESEIEQAVIKVKKELQKVGLI

SEQ ID NO: 22496 - protein, 466 aa, Zea mays
MPPSKARRKRSLRDITATVATGPVANSKPGSSSTNEGKQHDKKKEGPQEPDIPPLPPVVVNIVPRQGLGCEVVEGLLVPSRKREYKPNSKYTVGNHPIYAIGFNFIDMRYYDVFAIASCNSVIIYRCLENGGFGLLQNYVDEDKDESFYTLSWTIDQVDSSPLLVAAGSNRIIRVINCATEKLDKSLVGHGGSIHEIRTHASKPSLIISASKDESIRLWNVHTGICILVFAGAGGHRHDVLSVDFHPTEVGIFASCGMDNTVKIWSMKEFWIYVEKSYSWTGHPSKFPTRNIQFPVLTAAVHSDYVDCTRWLGDFILSKEKVALTAYLNCHHAATTKPCKYGFWRMDQSVKNAVLLWEPKPDKRRPGEGSVDVLQKYPVPKCSLWFMKFSCDFYSNQMAIGNNKGEIYVWEVQSSPPVLIDRTILGAADDGAIWRWDEVDPAASSSKPDQAAAPAAGAGADADADA

SEQ ID NO: 22497 - protein, 159 aa, Yersinia mollaretii
VLMPDASTAVMDPFFEDATLIIRCDILEPGTLQGYDRDPRSISKRAEEFLKSSGIADTVLFGPEPEFFLFDDVRFGSSIRGSHVAIDDIEGAWNSSTKYEGGNKGHRPAVKGGYFPVPPVDSSQDLRSTMCLTMEEMGLVVEAHHHEVATAGQNEVATR

SEQ ID NO: 22498 - protein, 512 aa, Vicia sativa
MELETLVAWLLFSATLLWLLLLATKTQSKSLKSPSSTTNSTIPKSYPIFGSIFSIAANFHRRVQWISDILQTTPSSTFILHRAFGSRQVFTANPLVVQHILKTNFPCYPKGLTLNRSLGDFLGNGIFNADGETWKLQRQISSHEFNAKSLRKFVETVVDVELSGRLLPILSEASKTEKILPDFQDILQRFTFDNICIIAFGFDPEYLLPSLPETAFAKAFDYGTRISSLRFNAAVPLIWKVKKILNIGTEQRLKEAVAEVRGLASRIVREKKQELLEKSALESLDILSRFLSSGHSDESFVIDIVISFILAGRDTTSAALTWFFWLLSKHSHVETEILKEVTAKSESVSYDEVKDMVYTHAALCESMRLYPPVPVDTKEVAYDDVLPDGTFVKKGWRVAYHIYAMGRSEKIWGSDWAEFRPERWLRRDEDGMWSFVGMDPYAYPVFQAGPRVCLGKEMAFLQMKRVAAGVLREFRVVPAMENGIEPEYTAHLTALMKGGFPVRIEKRSHTDE

SEQ ID NO: 22499 - protein, 428 aa, Pisum sativum
MRDQKGEVQYFIGVQLDGSQHVEPLHNRIAEDTAKEGENLVKKTAENVDDALRELPDANMKPEDLWMNHSKMVHPKPHRREDAAWRAIQKIMESGEQIGLKHFKPIKPLGSGDTGSVHLVELCGTDHQFAMKAMDKGVILNRNKEHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPQLLVPSTNDKKKGQHGPIFMAEPMRASNSFVGTEEYIAPEIITGSGHTSAVDWWALGILLYEMFYGYTPFRGKNRQRTFANILHKDLKFPKSKQVSLGAKQLIYYLLQRDPTSRLGSKGGANDIKNHSFFKGINWALVRCTKPPELDAPLFDTNKEEKEKEDKYVDNGQRI

SEQ ID NO: 22500 - protein, 134 aa, Staphylococcus aureus
HETDEEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 22501 - protein, 301 aa, Arabidopsis thaliana
IDFSDQTLKPGSSKWDEVKADVRKALENYGCFEASFDKLSVELNRSVFEAMEDLFELPIPTKQRNVSSKPFHGYLCHNLYESLGINDANVLEKVNDFTQQLWPDHGNKSISETIHRFSEKLVELDLMVRRMIMESFGIENYIDEHLNSTYYLTRLMKYTSPPDDDDDDDDEETKLGLRSHTDKNIITILHQYQVDGLEVKTKDDKWIKVKPSQDSVLVMVGDSLCALLNGRLHSPYHRVIMTGKKTRYSTGLFSIPKTGVIIDSPEELVDKEHPRIFKPFEYTDFLHFFQTEAGRIAQSAL

SEQ ID NO: 22502 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 22503 - protein, 216 aa, Zea mays
MEKKAGREHVIGIPVNNRAFGIEEPDFSSKGAARNAAAAGRAAKSGWTTGDRVAQGLKEHVALGPNLYETVRGKLSAGARILRAGGVEKAFRRWFSVVGKGERLLRASQCYLSTTAGPIAGTLFVSTERIAFRSDRSLALTSPKRGTVVLVRVPYKVSIPLGRVKTATPGGNKDRPEQKYVQVVTDDGFEFWFMGFVRYQVSLHELEKAIKQAQAQ

SEQ ID NO: 22504 - protein, 465 aa, Magnetospirillum magnetotacticum
LALVLMDAGYSTSLRDLMRNWRPIAGLAVGAVAATTAAVADIALWLVPDMPLSAAIVLGAVVAPPDAVAALSVLAHVSLPHRLATILRGESLLNDAASLLIYRLGVAAAVTGHFSAAEVAPAFLIGVVGSLVAGPLAALVYLRILRRVEEPMSTIVLQFSAAFGLWIVAEAVELSGVLTVVSFAITVARRAPGQTAPRLRVVSKAVWETAIFVLNVLAFVLIGEQIGPILARMSPEQETAYISVAGAVVATVILIRIAWVLPASALRRLGFEGGEAAGDPRQARDLGLGAGFALAWSGMRGLVTIAAALALPEGGPGGGAFPYRDLIVLTAFCVVIGTLVVQGLTLRPILGRLGLRDSDPVGFEVGRARAEAYGAAVEALRDDHSEAADALRREFHAALAEAEAHEEGLAPEGLPTDEPRRRAVRAARDRLLALRRSGSIGDDAYFVLEEELDWAELNATPRAEA

SEQ ID NO: 22505 - protein, 307 aa, Haemophilus somnus 129PT
MRLFMALIKEIKMKVIIPVAGLGTRMLPATKAIPKEMLTLVDKPLIQYVVNECVNAGIKEIVLVTHSSKNAIENHFDTSFELETMLEQRVKRQLLDEVRSICPTGVTIMHVRQGNAKGLGHAVLCGRAIVGKEAFAVVLPDVLLAEFDSNQKTENLAAMLKRFKETGNSQIMVSPVPDKDISSYGIVDCGGVTLNVGESVKISNIIEKPSFDDAPSNLSVVGRYVFSATIWDLLEKTPVGVGNEIQLTDAIGMLIEKEVVEAFHMTGKAFDCGDKIGYMQAFVEYGLQHPQLGENFKTYLKQLVQDL

SEQ ID NO: 22506 - protein, 474 aa, Grateloupia turuturu
RYESGVIPYAKMGYWDPDYVIKDTDVLALFRITPQPGVDPVEASAAVAGESSTATWTVVWTDLLTACDLYRAKAYKVDAVPNSSEQYFAYISYDIDLFEEGSIANLTASIIGNVFGFKAVKALRLEDMRIPVAYLKTFQGPATGIVVERERMDKFGRPFLGATVKPKLGLSGKNYGRVVYEGLRGGLDFLKDDENINSQPFMRWKERFLYSMEAVNRSIAATGEVKGHYMNVTASTMEDMYERAEFAKQLGTVIIMIDLVIGYTAIQSMGVWARKNDMILHLHRAGNSTYSRQKSHGMNFRVICKWMRMAGVDHIHAGTVVGKLEGDPLMIRGFYNTLLLTHLEVNLPQGIFFEQDWASLRKVTPVASGGIHCGQMHQLLDYLGNDVVLQFGGGTIGHPDGIQAGATANRVALESMVMARNEGRDYVAEGPQILQDAAKTCGPLQTALDLWKDITFNYTSTDTADFVETPTANV

SEQ ID NO: 22507 - protein, 331 aa, Streptomyces avermitilis MA-4680
MQLRELVFGAACAAAVRAAAKLGVADALGEKPATAEELAAVLGTEPRPLLRLLRALSCYGIFAQNDDGRFVHTSMSRLLREDDPHSLRYISLWCTEPWTWDAWPRLDEAVRSGGSVFHELYGKGFFDYLHEDAHDSAQVFNQAMTTSSEQSARDVAELLDLTGVSTVADIGGGQGHVLASLLEKHPDIRGTLLDLPRVVEKADPRLRDGGPLAARARIVGADCREEIPVEADLYIIKNILEWDDDSTRRTLRNVMTKARPGARVVIIENLVDDTPSMKFTTSMDLMLLLNVGGAKHTKESLVTRMTEAGLTVGEIRPVNAYLHAFECTVPA

SEQ ID NO: 22508 - protein, 384 aa, Escherichia coli O157:H7 EDL933
MSERRRSTCNLKYDEYKARRYRTRDMSKIFDFVKPGVITGDDVQKVFQVAKENNFALPAVNCVGTDSINAVLETAAKVKAPVIVQFSNGGASFIAGKGVKSDVPQGAAILGAISGAHHVHQMAEHYGVPVILHTDHCAKKLLPWIDGLLDAGEKHFAATGKPLFSSHMIDLSEESLQENIEICSKYLERMSKIGMTLEIELGCTGGEEDGVDNSHMDASALYTQPEDVDYAYTELSKISPRFTIAASFGNVHGVYKPGNVVLTPTILRDSQEYVSKKHNLPHNSLNFVFHGGSGSTAQEIKDSVSYGVVKMNIDTDTQWATWEGVLNYYKANEAYLQGQLGNPKGEDQPNKKYYDPRVWLRAGQTSMIARLEKAFQELNAIDVL

SEQ ID NO: 22509 - protein, 263 aa, Oryza sativa
DLAWLVGCSWRSIGMGRGRVELKRIENKINRQVTFAKRRNGLLKKAYELSVLCDAEVALIIFSNRGKLYEFCSTQSMTKTLEKYQKCSYAGPETAVQNRESEQLKASRNEYLKLKARVENLQRTQRNLLGEDLDSLGIKELESLEKQLDSSLKHVRTTRTKHLVDQLTELQRKEQMVSEANRCLRRKLEESNHVRGQQVWEQGCNLIGYERQPEVQQPLHGGNGFFHPLDAAGEPTLQIGYPAEHHEAMNSACMNTYMPPWLP

SEQ ID NO: 22510 - protein, 275 aa, Glycine max
MGTLGNEEPGTQIPENAKSFSLFRYNSPFIQIVLIGLVCFCCPGMFNALSGMGGGGQVNSTASNNALTALYTTFAIFGIVGGGIYNILGPHLTLFAGCSTYVLYAGSFLYYNHYQHQFFAIVAGAILGVGAGLLWAAQGAIMTSYPPENRKGTYISIFWSIFNMGGVIGGLIPFILNYNRGDSAATVNDGTYIGFMVFMSVGAVLSLTILPASKVVRNDGTRCTNMLYSNVATESVEILKLFYNWKMLLIIPAAWSSNFFYTYQFNHVNKPQFNL

SEQ ID NO: 22511 - protein, 605 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 22512 - protein, 485 aa, Candida tropicalis
MAPTFTNSNGQPIPEPFATQRVGQHGPLLLQDFNLIDSLAHFDRERIPERVVHAKGSGAYGVFEVTDDITDVCAAKFLDTVGKKTRIFTRFSTVGGELGSADTARDPRGFATKFYTEEGNLDLVYNNTPVFFIRDPSKFPHFIHTQKRNPETHLKDANMFWDYLTTNEESVHQVMVLFSDRGTPASYREMNGYSGHTYKWSNNKGEWFYVQVHFISDQGIKTLTNEEAGSLAGSNPDYAQEDLFKNIAAGNYPSWTCYIQTMTEAQAKEAEFSVFDLTKVWPHGKYPMRRFGKFTLNENPKNYFAEVEQAAFSPAHTVPHMEPSADPVLQSRLFSYADTHRHRLGTNYTQIPVNCPVTGAVFNPHMRDGAMNVNGNLGNHPNYLASDKPIEFKQFSLQEDQEVWHGAATPFHWKATPADFKQATELWKVLKKYPNQQEHLAHNVAVHASAADAPIQDRVIAYFTKVHPDLGDLIKKEILELSPRK

SEQ ID NO: 22513 - protein, 445 aa, Glycine max
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 22514 - protein, 102 aa, Zea mays
IEGSKSQTLTDEGVEPHETGAKTAEEREETKKLQEKHAALKPNGGNGTTKGCTGTKNDKEVRNGHTKPDPMENQKETQNKKKGSKDPKPPKKRGNTHDDTQK

SEQ ID NO: 22515 - protein, 118 aa, Triticum aestivum
  unsure (1)..(118): unsure at all Xaa locations
MGATIQSAKGRQIFDSRGNPTEEVDVCXSNGTFDRGDGSSGASTGVHEALKLRDRGADYLGKGVSNARDNVNLIIEPALIGKDLISYTDLRXFMVHQLDGTINXWGWFKHNSRFNVIL

SEQ ID NO: 22516 - protein, 239 aa, Oryza sativa
MSRKRLVGMFEYPSLEAATEKFSESNMLGVGGFGRVYKAAFDAGVTAAVKRLDGGGPDCEKEFELDLLGRIRHPNIVSLLGFCIHEGNHYIVYELMEKGSLETQLHGSSHGSTLSWHIRMKIALDTARGLEYLHEHCSPPVIHRDLKSSNILLDSDFNAKIADFGLAVSSGSVNKGSVKLSGTLGYVAPEYLLDGKLTEKSDVYAFGVVLLELLMGRKPVEKMSPSQCQSIVTWVQCNV

SEQ ID NO: 22517 - protein, 504 aa, Vibrio parahaemolyticus
MQMSKSFLLITVGLASTSLQAQTLTRDNGAPVGDNQNSITAGENGSVLLQDVHLIQKLQRFARERIPERVVHARGTGAHGEFVASGDFSDLTVSAPFTEKGKVTPVFVRFSTVIHSKGSPETLRDPRGFATKFYTEQGNWDLVGNNLPVFFIRDSIKFPDMVHSLKPSPVTNVQDPNRFFDFFSHEPSATHMLTWVYSNLGTPASYRTMDGFGVHAYKWINQQGDVNYVKFQWKSQQGIKSLRPNKVTEMQGKDFNHLTNDLYAAIGRGNYPKWDLYVKVLSPEALSKLDYNGLDATKVWLNVPDRKVGTMTLNRLPENFFLETEQSAFAPSNLIPGIEPSEDRLLQGRLFAYADTQLYRLGANLFQLPVNRPLTSVNNHNQNGLSNNAQLSNGDVNYEPSRKLNLAEDNQFKAVETKLVGTVQQKAISKPRDFYQAGVLYRSMNEQDRSDLIANLAGDLNKVIDKDIKATMVSYFYRADKEYGSRLAEATDTNLSQVKNKAMM

SEQ ID NO: 22518 - protein, 176 aa, Glycine max
  unsure (1)..(176): unsure at all Xaa locations
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFLYHEHNRSPXYYDGRYWTMWKLPMFGCADASHVLKDLXDAKTGYPDGXVRIMGCDTFGSADRELICYNLPR

SEQ ID NO: 22519 - protein, 460 aa, Craspedocarpus venosus
WDPEYVIKETDVLALFRVSPQPGVDPIEASAAVAGESSTATWTVVWTDLLTACDLYRAKAYKVDAVPNTSDQYFAFISYDIDLFEEGSITNLTASIIGNVFGFKAVKALRLEDMRIPVAYLKTFQGPATGVISERERMDKFGRPFLGATVKPKLGLSGKNYGRVVYEGLRGGLDFLKDDENINSQPFMRWKERYLYAMEGVNRSVAATGEVKGHYLNVTAATQEDMYERTEFAQQLGSIIIMIDLVIGYTAIQTMGIWARKNDMILHLHRAGNSTYSRQKIHGMNFRVICKWMRMAGVDHIHAGTVVGKLEGDPVMIRGFYDTLLLSYLKVNLPQGIFFEQDWASLRKVTPVASGGIHCGQMHQLLDYLGVDVVLQFGGGTIGHPDGIQAGATANRVALESIVIARNEGRDYVAEGPQILQDAAKTCGPLQTALDLWKDITFNYTSTDTADFVETPTSNV

SEQ ID NO: 22520 - protein, 297 aa, Zea mays
MAPPLALFLLAAIVLSRAVSHAHGGGGGFYDPASVTQLSSRPRAFLYSGFLSDTECDHLVSLAKGSMEKSMVADNDSGKSVASQARTSSGTFLAKREDEIVSAIEKRVAAWTFLPEENAESLQVLRYETGQKYDAHFDYFHDRNNLKLGGQRVATVLMYLTDVKKGGETVFPNAEGSHLQYKDETWSECSRSGLAVKPKKGDALLFFNLHVNATADTGSLHGSCPVIEGEKWSATKWIHVRSFDNPPDVRTDAPCSDDKELCPRWAAIGECHRNPTYMVGTKDTLGFCRKSCGICDA

SEQ ID NO: 22521 - protein, 487 aa, Chlamydomonas reinhardtii
MPLAELWRLTKLVPLACTVLLLSVRALAVDSGGLNDSADNSSRSLLQESGQASGTSQPYTYSSSDFVLLNGFLIFFMQIGFVSAESGQGRAKNVRNILLKNSVNIMLCAICWWAVGYAFAYGNSGGGFIGTSRFFSDGESFGSKPWFFTWTFCLSCVTIASGCLAERTHLFVYPVYTAVVSIAVHPVIAHWVWAPDSWLNSMTGSPCRFLDFAGGAVVHTVGGLTGLIGAMLCGPRLGRFEDGVGKDIPGHDVSSVSLGSLMLWFGWYGFNCGSTYIYMAQGGSEASAAVSRVALNMTLCASVAGMTSLVVSSIQTGTFDLAVCCNGLMAGLSASTSNVGFLTPWAACITGALAGLLYVGISRLLVRMGVDDPLDSSAIHCGSGILGVLVSGFLARPSYVMQMVGCNCGGVVYATNGGMQLGMQLLGLSCSMVWTAMWALLTFGILKKLQLLRVDQQTELAGIDNMEHGGPAYPEFLQRVQSTRPGY

SEQ ID NO: 22522 - protein, 411 aa, Vibrio parahaemolyticus RIMD 2210633
MGCCDAPGLMPIEEAMDKMLSRIKPIQTTLSLPLADALGFVLAEDVLSPIHVPPFDNSAMDGYAIRIQDLEASTVLPMVGKSFAGQPFEGEWPTGTCVRIMTGAKIPEGCDAVIMQENTTVTEAGIQFNQTDVKPQNNIRPTGDDIKQGDIVLAKGARLTPRDIPMIASLGVSHITVVRKPKVAFFSTGDELKPLGEPLEAGQIYDSNRYGIKPLIENFGCEAIDLGIIPDCPETLKATFEKAQTLADVVVTSGGVSVGEADYTKDILEQLGEIGFWKLAIKPGKPFAFGKLSTAWFCGLPGNPVSAVLTMYVLVQPMLAKLAGHTEWKAPESIPATTKTAFKKAPGRTDYQRGIYTLEDGKFVVETTGNQSSGAFRSMSLANCFVVLERERGRVEVGETVQIQLFNSTLY

SEQ ID NO: 22523 - protein, 340 aa, Glycine max
MDHSADAQRTDLMTITRFVLNEQSKHPESRGDFSILLSHIVLGCKFVCSAVNKAGLAKLIGLAGETNVQASEQKKLDVLSNDVFIKALVSSGRTCILVSEEDEEATFVEASKRGKLYCVVFDPLDGSSNIDCGVSIGTIFGIYLIKEDHEPTIEDVLQPGKNMLAAGYCMYGSSCTLVLSTGSGVNGFTLDPSLGEFILTHPDIKIPKKGKIYSVNEGNAKNWDDPTTKYVENCKYPRDGSSPKSLRYIGSMVADVHRTLLYGGIFLYPADKKSPNGKLRVLYEVFPMSFLMEQAGGQAFTGNQRALDLVPKKLHERFPIFLGSYEDVEEIKALYSADEK

SEQ ID NO: 22524 - protein, 388 aa, Streptomyces coelicolor A3(2)
MTVMEQRGAYRPTPPPAWQPRTDPAPLLPDTEPYRVLGTKAADRADTELLRTLYARLVRGRRYNAQATALTKQGRLAVYPSSTGQEACEIAAALALEERDWLFPSYRDTLAVVSRGVDPVEALTLLRGDWHTGYDPYEHRVAPLSTPLATQLPHAVGLAHAARLKGDDVVALAMVGDGGTSEGDFHEALNFAAVWRAPVVFLVQNNGFAISVPLDKQTAAPSLAHKAVGYGMPGRLVDGNDAAAVHEVLSDAVRHARAGGGPTLVEAVTYRVDAHTNADDATRYRGDAEVETWRRHDPVELLERELTERGLLDEDGIRAAREDAETMAADLRARMNQDPELDPLELFAHVYAEPTPQLREQRDQLRAELAAEAETAARQAGALEGGRR

SEQ ID NO: 22525 - protein, 341 aa, Magnolia quinquepeta
MGGKKIKIGINGFGRIGRLVARVALQRDDVELVAVNDPFITTDYMTYMFKYDSVHGQWKHHELKVKDSKTLLFGEKPVTVFGVRNPEEIPWGETGAEFVVESTGVFTDKDKAAAHLKGGAKKVIISAPSKDAPMFVVGVNEHEYKSNIDIVSNASCTTNCLAPLAKVINDKFGIVEGLMTTVHSITATQKTVDGPSSKDWRGGRAAGFNIIPSSTGAAKAVGKVLPALNGKLTGMAFRVPTVDVSVVDLTVRLEKAASYEEIKAVIKAESEGKLKGILGYTEEDVVSTDFIGDNRSSIFDAKAGIALNEHFVKLVSWYDNEWGYSSRVIDLILIVHMASCQ

SEQ ID NO: 22526 - protein, 338 aa, Vibrio parahaemolyticus RIMD 2210633
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 22527 - protein, 149 aa, Gibberella zeae
RVIMGVGIGGDYPLSSIITSEFATTKWRGAMMAAVFAMQGIGQLVAALVMMFLTLGFKSSLEQAADTKSCTGDCQIAVDKMWRTLVGFGAVPACIALYYRLTIPETPRYTFDVARDVEQADEDVKAYINGKSEGNTDEVTRAQNLQSAK

SEQ ID NO: 22528 - protein, 199 aa, GIBBERELLA ZEAE PH-1
MIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKSFASENHLSFIETSALDASNVELAFQNILTEIYRIVSSKALDSGDSAQATIGAGTNISLSKPADDDAAKGGKCC

SEQ ID NO: 22529 - protein, 336 aa, Petroselinum crispum
MKMKIGINGFGRIGRLVARVALMSDDIELVAVNDPFITTEYMTYMFKYDSVHGQWKKDELKVKDSKTLLFGDKPLTVFGVRNPEEDPWGEAGAEYVVESTGVFTDKDKAAAHLKGGAKKVVISAPSGNAPMFVVGVNEKEYKKDIDIVSNASCTTNCLAPLAKVLNDKFGIVEGLMTTVHSITATRKTVDGPSMKDWRGGRAASFNIIPSSTGAAKAVGKVLPALNGKLTGMAFRVPTVDVSVVDLTARLEKAATYDEIKAAIKHESETSLKGILGYTEDDVVSTDFVGDSRSSIFDAKAGIALNGNFVKVVSWYDNEWGYSNRVIDLIRHMASVA

SEQ ID NO: 22530 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCPDATQVINEVEEVKKEYPDAYVRIIGFDNMRQVQWVSFIAFKPPGCEESGKA

SEQ ID NO: 22531 - protein, 355 aa, Chlamydomonas reinhardtii
MASDAMTINEALMEVEHTPAVHKRILDILPGISGGVARVMIGQPFDTIKVRLQVLGQGTALAAKLPPSEVYKDSMDCVRKMIKSEGPLSFYKGTVAPLVGNMVLLGIHFPVFSSVRKMLEGDDHYSNFSHANVLLSGAAAGAAGSLISAPVELVRTKMQMQRRAALAGTVAAGAAASAGAEEFYKGSLDCFKQVMSKHGIKGLYRGFSSTILRDMQGYAWFFLGYEATVNHFLQNAGPGVHTKADLNYLQVMAAGVVAGFGLWGSMFPIDTIKSKMQADSFVKPQYSTTIDCVKQVIASEGQAGLWRGFSAAMYRAIPVNAGIFLAVEGTRQGIKWYEENVEHIYGGVIGPATAQ

SEQ ID NO: 22532 - protein, 731 aa, Oryza sativa; identical to SEQ ID NO: 9427

SEQ ID NO: 22533 - protein, 554 aa, Clostridium perfringens str. 13
MVFMKSFRVSVNGESLLFNEGEKYSVILKKDYINEKIPITLVKQRNKYYEFTDLINNDGDIELINISDPHGKIAYSRTLQFVFIKATLDLFKDARINIEHSISKGTFGEIHKEKALDEEDILKIKKKMQEIINKNIIIEKIKMPKKEAIDIFKSYKMQDKVDLLHWVQEEYVNLYKLEDRYDYFYGDMAYSTGVLKYFDLLYYNPGFILMVPSHKEPTVVPVFKEQKKLFNVFRENETWLNILGTPDVGSLDYKLEGEESSDIIRVSEALHEKKIAQIADMISDRKEVKIVLVAGPSSSGKTTFSKRLSIQLRVNGYIPIAISLDDYFINRIHTPLDEEGKPDFESINALDLELFNKNLYDILEGEEVEIPSYNFKIGEREWLGNKIKLPDNGVLVIEGIHGLNPKLTEKIPSKNKFKVYISALTQLNLDNHNRIPTTDVRKIRRIVRDSLSRGYGAEQTLEMWSSIKRGEEKNIFVYQEEADVMFNSTLVYELAALKEYALRELEKVDKNSSVYYEAKRIINTLKFFVEVKPERVPENSILREFIGGSCFYKY

SEQ ID NO: 22534 - protein, 69 aa, Zea mays
MIHNRRLDHASFMVWKDEAFEIWTRGWGCMFPEGDSSRELLEKVQKTYYLVSLVDNDYVQGDLFAAFKI

SEQ ID NO: 22535 - protein, 322 aa, Streptomyces avermitilis MA-4680
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 22536 - protein, 333 aa, Oryza sativa
MAAWLGCADDAVEPARRDNEGVGYKRAQFRDRKNTLDHPSAPMGRKRCIGTELENLGATCIGAEFEHLSALQPRMTMFQTAKGKAKPLLANSKTFWNVSSFESPAPKSHPSSSSFLCKQSNPVEHHAPHPSSTSLLRSRSPPPAMVLELQVFIVGWNPMHSQRSMQATMICVDDSVWMLKEDYPPTRLQAQADAANLVFATKMAVRLQPREHGRVPAMAGDRVRVLLALTSDPVKFLACMRGLKVSGEANLTAALEVAELALRNHADKTLSQRIVVFVGRRRAADLITAHSHRGSSSGRGRIGVRLRQRQFRDEEERRRGASSHGSETRRFGR

SEQ ID NO: 22537 - protein, 458 aa, Geobacillus stearothermophilus
MSGPNDIDEAVQAAKEAQRQWALVPAPKRAEILYKVGMLLKERKEQLARLLTMEMGKVIEEARGEVQEGIDMAFYMAGEGRRLFGDTTPSELKDKFAMSVRTPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQEFERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 22538 - protein, 163 aa, Synechocystis sp. WH 8501
MASLWKLPIIYVVENNKWAIGMAHDRATSEPEIYKKASVFDMVGVEVDGMDVLAVRKVAQEAVDRARAGEGPTLIEALTYRFRGHSLADPDELRSPDEKQFWGNKDPIQRLEAYLIEHNLANQSELDEIKQKVQASVDDAVKFAEESPEPDPKELYRYIFAED

SEQ ID NO: 22539 - protein, 273 aa, Glycine max
  unsure (1)..(273): unsure at all Xaa locations
AQICACDCFRHRWTVRYEAHLWDKNCWNESQSKKGRQATSLFCSLLSPYKAAARDNDFAALKYWGQDTILNFPLSNYEEKLKEMEGQSKEEYIGSLRRKSSGFSRGVSKYRGVARHHHNGRWEARIGRVFGNKYLYLGTYATQEEAAAAYDMQENSGRWXTIEYRGLNAVTNFDLSRYINWPRPKTEENHQTIPSNENVNSNAELELGSASDEITEEGVAPSSESNPSRRTFPEDIQTIFENQDSGIYTENDDIIFGDLGSFGAPIFHYELDV

SEQ ID NO: 22540 - protein, 446 aa, Corynebacterium efficiens YS-314
MFMGAGKTISLAGPSVILVYAIIGFMLFFVMRAMGELLLSNLNYKSLRDAVSDILGPGAGFVTGWTYWFCWIVTGMADLVAITGYVQYWWSGVPLWLPGAGAILLLFVLNLAAVRLFGEMEFWFAIIKILAIVALIFTGLVMVVSHFESPDGSVAQFSNLVDHGGFFPNGITGFLAGFQIAIFAFVGIELAGTAAAETEDPVRTLPRAINSIPVRIVVFYVLSLAVIMMVIPWDRVHTDSSPFVQMFALAGLPAAAGIINFVVLTSAASSANSGIFSTSRMLFGLSLEGAAPRRWAKLSANQVPARGLLFSIVCLIPGVAVMYAGSSIIEAFTLITTVSSVLFMVVWAYILVAYIVYRRRNPQLHAASVFKMPGGVAMAVVVLVFFVGMVGVLTLENDTRSALLATPVWFLILGAGWWFSGGARGAASRSQLTGPTTPVTPATTAS

SEQ ID NO: 22541 - protein, 512 aa, Schizosaccharomyces pombe
MSSVNSIPTATSTVYISVLPATATPSGGSGGNVLHEDLNKFYDYGNTSWILACTPLCLIMVPGVAFFYSGLARRKNTLALIMLSMLGLCVSFFQWYFWGYSLAFSQTGTSGYIGNLRHFAFIRTLADYSPGSNNIPELVFANFQGMFAAITVALFTGAAAERGRIGPMLIITFVWLTVVYCPIACWIWNPNGWAFKFGVYDFAGGGPVEVGSGFAALAYTVCLGRRSKFVEEQFRPHSVLNVVLGTSLLWFGWLGFNGGSAYGSNLRAAMAITNTNLAGAVAGLVWVIYDYIFRTRKWSTIGFCSGVVAGLVAATPCAGFVSPHASLAIGAITGLCCNWAIKLKSHMRIDDAMDIFAIHGVAGFVGTFLNGLFAVDYIAAMDGIYVGENKIRGGWFDHHWRQLGLQMAYICAVGAYDFVVTFIILFITDKIPYLQLRVSPDAEEIGVDADQIGEYAFDYIEERREYKHWKISPAGVPEEIIISNGVAQPTGNVAAPGKILESTNPLELGLTI

SEQ ID NO: 22542 - protein, 183 aa, Triticum aestivum
MAKHHPDLIMCRKQPGIAIGRLCEKCDGKCVICDSYVRPCTLVRVCDECNYGSFQGRCVICGGVGISDAYYCKECTQQEKDRDGCPKIVNLGSAKTDLFYERKKYGFKKRWTTFLALSGPPGLSFCAVTLIPEAGCWGSGIVSVLSFDPYIQECIPDMLCCMVQNSRLHMQYALDVNDHECLT

SEQ ID NO: 22543 - protein, 468 aa, Acidithiobacillus ferrooxidans
MGYSPSDVVKLIQEKDIKFIDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPEFFVFDSVTWNIDMSGCAYKVDAEEAAWNSGKEYESGNMGHRLGVKGGYFPVPPVDSAQDLRSAMCLAMEEMGLKVEVHHHEVATAGQHEIGVGFNTLTPRRMRCKILKYVVHNVAAVRQTATFMPKPVVGDNGSGMHVHQSLGKDGKNIFAGDLYGGLSEIALYYIGGIIKHAKAVNALTNPSTNSYKRLVPHFEAPVLLAYSAKNRSASIRIPYVNSPKARRIEVRFPDSTANPYLAFSAMLMAGLDGIQNKIHPATAMDKNLYDLPAEEQANIPGVAASLEEALRALEADHDFLMKGGVFSESWLEGYLDVKWAEVQTLRVTTHPVEFQMYYSL

SEQ ID NO: 22544 - protein, 525 aa, Pseudomonas syringae pv. syringae B728a
MASHYVSELSGLQQIAPNAKVDFIEGLSLDPSTSAWTTTDATGNEVQGMKVEYFSNTNWSGDAAVTRTEKHVDLDWANDKNLPFESNTSTSDPYASKGSTAGQLNGDTSSTSIRYTGKVTPTQSGEQVFKVRADGAVRLWVNGKKIIDNGDGKPLPGNSIPPTIPEFAKINLEAGQSYDVKLEYSRRAGYLSTMGGLVGVQLSSASLNAPQDLSGYDAVVVAVGNSNEYEGEGFDHSFDLPEFQNELIQNIAKVNPNTVVTMYGGTGLKMSDWIEQVPAALHAFYPGQNGGQALAEILFGKVNPSGKLPISIERNIEDNPAYASFPKFDNQNTLTDMDYKDDLLLGYRGYEKKGIKPLYPFGYGLSYTTFGYSNIKVTPGVAVGNTPIKVSFDLSNTGKVGGSEVAQLYVGQQNPKVERPIKELKGYKKVFLKPGESKRVTIELNDRSLAYFDEKSKQWVVDADTFNISLGSSSQDIRLNAKLVNSFRQELSTTSSNPLPRSALNSVLVEKPPVKTGGVFKQTVE

SEQ ID NO: 22545 - protein, 342 aa, Chloroflexus aurantiacus
MTLSINEISTDPGFGHDLPPHTLRDMLRYMMLARALDERMWVLNRAGKAPFVISCQGHEAAQVGAAFALMRGKDFILPYYRGLATVLVMGMTPTEVMLGLFARATDPSSGGRQMPAHYGCRRLKIVTQSSPVGTQIPHAAGIGLAEKIKGGDAVVWVSFGEGTTSQGDFHEGVNLAAVHRLPVIFQCENNEYAISVHQRQQMAIGSVAERAAAYGIPGISVDGTDVLAVYEVTRRAVERARRGDGPTLIEARVVRMTAHSSDDNDRTYRPPHEIALVRHQDPIVRFVAQLREHGILSEAEEQEMRAEVKAIVDRATEEAERAPMPEPETLYDHVYAPLRQRR

SEQ ID NO: 22546 - protein, 170 aa, Helicobacter pylori
GSGMHTHVSIWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 22547 - protein, 108 aa, Zea mays
FCSAHVCAWLQLINPAETFGDIVIDYPYVECTSAAIQALTSFKKLYPGHRRKEVDNCISKASNFIESIQKSDGSWYGSWAVCFTYGTWFGVKGLIAAGRTFENSPAGM

SEQ ID NO: 22548 - protein, 436 aa, Streptomyces avermitilis MA-4680
MTLAAARIDTGDTAWLLAATALVLLMTPGLALFYGGMVRTKSVLNMLMMSFVSIALVTVVWLAAGYSLAFGDDLAGGLIGGLDHAGLADLGPADVHGTVPTLLFATFQLTFAIITAALISGAIADRAKFAAWLVFVPLWALLVYVPVAHWVWGPGGWILDRLGALDFAGGLPVEITSGASGLALCLVLGPRLGFKKDAMRPHNLPMVMLGAGLLWFGWFGFNAGSALGANGLAAAAFLNTLAAGCTGLLGWLFVEQKRDGHPTTLGAASGAVAGLVAITPSCGAVSLLGALVVGLAAGVVCSYAVGWKFKLNYDDSLDVVGVHLVGGIIGTLLIGVFAAKEMTGGTEGLLYGGGLGQLGKQLVAVVAVGAYAFAVTYGLGKLIDKVMGLRAAEDDEHQGLDLTVHAETAYDHGILGHGAPSSASVVPTAQKVKSQA

SEQ ID NO: 22549 - protein, 171 aa, Neurospora crassa
MSGKQDPPPYNQPQPPQAAYTGYGTPPPGQEGAYPYGQPPPQQGGYYPPQAQGYPPQGPGYPPQGPYPPQGQYGQQPGPYQQGPQMGYYPQQQPPPGAYYQQGPPPQGYYQQPVEQKSGSDTGEEWLWDVWLLPLAATGSKRVRLRADKEVLVALEIDVTVSLIISYKPGM

SEQ ID NO: 22550 - protein, 222 aa, Zea mays
RKNEIKFPQHELIKARVSFLSSFGSVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 22551 - protein, 473 aa, Claviceps purpurea
MASEVSVASSGSEHSGAQKCPFQDPGLSSMDQDSRLRDILSRFNREKIPERAVHARGAGAYGEFEVTHDVSDICDIDMLLGVGKKTPCVVRFSTTTLERGSAESVRDVKGMAIKHFTQDGNWDWVCLNIPMFFIRDPSKFPDMVHAQRPDPTTNVANPSRWWEFVCNNHETLHMVMFQFSDFGTMFDYRSMSGYAAHAYKWVMPDGSWKYVHWFLASDQGPNFETGHQAKQIGADDAESATRDLYQSLERGEYPSWTVKVQVVDPEDAPKLPFNILDVTKHWNLGNYPPDIDVIPGRTLGKLTLKKEPQDYFEEIEQLAFSPSRLVHGVEASEDPMLQARLFAYPDAQKHRLGPNNLDLPANRTKKFADGARPEKAEMAPQKVPSQEHADWVSQVKSSSWSEPNETDYKFPREFWKALPRLRGEAFQNSLVVNMAKSVSQVPVDMREKVYSTLALIADDLADRVRTMTEEIVE

SEQ ID NO: 22552 - protein, 419 aa, Vibrio vulnificus CMCP6
MDILANYGTVLIIVAAVFGFMMAIGIGANDVANAMGTSVGSKALTVKQAIIIAMIFEFAGAYLAGGEVTDTIRKGVIETSLFAHQPDVLVFGMMSALLAAGTWLLLASYMGWPVSTTHSIIGAIIGFACVSVGTEAVDWSSVQGIVGSWIITPLISGFFAYVIFVSAQRLIFDTEKPLMNAKRFVPVYMFITTMVIALVTIKKGLKHVGLHLSSTEAWFWSAGVSGLVMLGGYLYIQKKFANREDDHGFAGVESIFSVLMVITACAMAFAHGSNDVANAIGPLSAVVSTIEHMGEVTAKSTIAWWILPLGGFGIVVGLATMGHKVMATVGTGITELTPSRGFAAQLATASTVVLASGTGLPISTTQTLVGAVLGVGFARGIAALNLGVVRNIVASWVVTLPAGALLAVVFYYAMQAIFG

SEQ ID NO: 22553 - protein, 541 aa, Oenococcus oeni MCW
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWEPKY

SEQ ID NO: 22554 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 22555 - protein, 202 aa, Triticum aestivum
MGALRFPAATFAHLPTPPPPHRAAIAAAIAAAAAAAAAAGFALTAKSAGRPLPRPSHSASLWASLSLADSGAPGNVEPRTGARFPAETAGGRRLLGVGLRKTTILGLKFIDVYAFGGYADDSELKQLRDKYQKLPISDLKENDELINDALERDIRMTVRLQIVYGRLSIGSVRSAFEKSVGSRLQKFGGSDTKELLQSFVSL

SEQ ID NO: 22556 - protein, 201 aa, Triticum aestivum; identical to SEQ ID NO: 12950

SEQ ID NO: 22557 - protein, 243 aa, Zea mays
  unsure (1)..(243): unsure at all Xaa locations
MGRGRVELKRIENKINRQVTFAKRRNGLLKKAYELSVLCDAKVALIIFSNRGKLYEFCSLESITKTLERXEKNSYGGPDTAVQNKENELVQSSRNEYLKLKARVDNLQRTQRNLLGEDLGSLGVKELEQLEKQLDSSLRHIRSTRTQHMLDQLTDLQRREQMLCEANKCLRRKLEETSNQVHGQVWEHGANLLGYERHSPQQQAPSHVGNGLFFHPLEAAAEPTLQIGFAPEHMNNFMPTWLP

SEQ ID NO: 22558 - protein, 167 aa, Glycine max
MAASAGGQITLSSTVQLHGVPCSRNGKLVKFCNGEVMGRKLVLKSAYGGSTKDVRRHQQQQHICMSLTADVSTESNVRDLDMERRNPRTVLAGILGGGAGTRLFPLTKRRAKPAVPIGGAYRLIDVPMSNCINSGINKVYILTQFNSASLNRHIARAYNSGNESPFE

SEQ ID NO: 22559 - protein, 342 aa, Solanum tuberosum
MLKSIVRRSSTAGASYVSRRGFASGSAPERKVAVLGAAGGIGQPLSLLMKLNPLVSSLSLYDIAGTPGVAADVSHINTRSEVVGFAGEEQLGKALEGADIVIIPAGVPRKPGMTRDDLFNINAGIVKSLCTAIAKYCPNALVNMISNPVNSTVPIAAEVFKKAGTYDEKKLFGVTMLDVVRAKTFYAGKAKVNVAEVNLPVVGGHAGITILPLFSQATPKANLSNEEIVALTKRTQDGGTEVVEAKAGKGSATLSMAYAGAIFADACLKGLNGVPDVVECAFVQSNVTELPFFASKVRLGKNGVEEVLGLGPLNEYEKQGLEALKPELLSSIEKGIKFAKEN

SEQ ID NO: 22560 - protein, 253 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEQREAGSTMDVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 22561 - protein, 55 aa, Synechococcus sp. PCC 7942
MILPGAVVRVTNPSDIYYGYQGYVQRLSRGKVAVLFEGGNWDKLVTFRLSEVAPA

SEQ ID NO: 22562 - protein, 215 aa, Fusobacterium nucleatum subsp. nucleatum ATCC 25586
MTNGIKIAPSILSSDFSKLGEEVAAIDKAGADYVHIDVMDGQFVPNLTFGPPVIKCIRKCTGLIFDVHLMIDKPERYIEDFVKAGADIVVVHAESTIHLHRVIQQIKSFGIKAGISLNPSTPEEVLKYVINDIDMVLVMSVNPGFGGQKFIPAVVEKIKAIKKMRVDIDIEVDGGITDETIKVCVDAGANIFVAGSYVFSGNYKERIDLLKLKAK

SEQ ID NO: 22563 - protein, 555 aa, Oryza sativa (indica cultivar-group)
MADADGGSNLAVLDALDSARTQMYHMKAIVIAGMGFFTDAYDLFCISTVSKLLGRLYYQPDGLTDSKPGALSKTANNMVIGVALVGTLMGQLVFGYFGDKLGRKRVYGVTLILMAACAIGFGLSFGSSRKAVIGTLCFFRFWLGFGIGGDYPLSATIMSEYSNKKTRGAFIAAVFAMQGVGIIFAGLVSMIVSSIFLTYNKAPSYKGNHDLSRQMPAADYVWRIVLMIGAFPALATFYWRMKMPETARYTAIIDGNAKQAANDMQKVLSIEIEAEQEKLAKFNAANNYPLLSMEFARRHGLHLIGTTTTWFLLDIAFYSQNLTQKDIFPAMGLISGAAEVNALTEMFQISKASFLVALLGTFPGYWVTVALIDKMGRYMIQLIGFFMMSMFMLAMGILYDYLKTHHFLFGLLYALTFFFANFGPNSTTFVLPAELFPTRVRSTCHAISAAAGKAGAIVAAFGIQKLTYNSQVKSIKKALIILSITNMLGFFFTFLVPETMGRSLEEISGEDGNTGAGGGGAPAAANAGVGVSASDVSRDEKFPASSTEWQTSMHA

SEQ ID NO: 22564 - protein, 136 aa, Zea mays
  unsure (1)..(136): unsure at all Xaa locations
LSYKAVPVADPLDSKDGXRFPRPFLLYFSYGLLDAMFQSLIYWIIGALANDSQILSRYVGFYKGVQSAGAAVAWQVDRRHTPLMSQLIVNWGLMTISYPLLALLVFLAVKDESYSVSSVEDGREKDSKLSAPTSFH

SEQ ID NO: 22565 - protein, 349 aa, Novosphingobium aromaticivorans
MIASSVAEEAAFALRSLQQAHANNKRYDASDAELLKFYEQMVLIRRFEEKAGQLYGLGLIGGFCHLYIGQEAVAVGLQSALKEGHDSVITGYRDHGHMLAYGIDPKVIMAELTGRGAGISRGKGGSMHMFSTDHKFYGGHGIVGAQVPLGAGLAFAHKYRGDDGVCMAYFGDGAANQGQVYETFNMAALWKLPIIFVVENNGYAMGTAVKRGSAETEFYRRGTAFRIPGMDVNGMDVLEVRQAAEVALEYVRAGNGPVLMELNTYRYRGHSMSDPAKYRSREEVQEMRDKHDPIEGAKAELLKRGVTEDKIKEIDKRIRQIVAESADFAETSPEPDMAELYTDVLVEKY

SEQ ID NO: 22566 - protein, 200 aa, Thermosynechococcus elongatus BP-1
MIIVIDNYDSFTYNLVQYLGELGRDFPVAADLRVFRNDQITLDEIAALAPAGVVISPGPGRPADAGISEPLIRTYAEQLPILGVCLGHQAIGEVFGGTVTLAPTLMHGKTSAIYHKGVGVFQDLPQPFTATRYHSLVIDRDSCPEVLEITAWTEDGLIMGVRHRQYPTLEGVQFHPESILTTCGKDLLRNFLRQLSSPAL

SEQ ID NO: 22567 - protein, 488 aa, Porphyra umbilicalis
MSQSVESRTRIKSERYESGVIPYAKMGYWDADYVIKDTDVLALFRITPQPGVDPIEASAAIAGESSTATWTVVWTDLLTACDLYRAKAYRVDPVPNVADQYFAYIAYDIDLFEEGSIANLTASIIGNVFGFKAVKALRLEDMRMPVAYLKTFQGPATGLIVERERMDKFGRPFLGATVKPKLGLSGKNYGRVVYEGLKGGLDFLKDDENINSQPFMRWRERYLYSMEGVNKASAAAGELKGHYLNVTAATMEDMYERAEFSKVVGSVICMIDLVIGYTAIQSMAIWARKNDMILHLHRAGNSTYSRQKNHGMNFRVICKWMRMAGVDHIHAGTVVGKLEGDPLMIKGFYNTLLESETDINLPQGLFFAQNWASLRKVVPVASGGIHAGQMHQLLDYLGDDVVLQFGGGTIGHPDGIQAGATANRVALESMVMARNEGRDYVAEGPQILRDAAKTCGPLQTALDLWKDISFNYTSTDTADFVETPTANV

SEQ ID NO: 22568 - protein, 75 aa, Zea mays
  unsure (1)..(75): unsure at all Xaa locations
EKATIRKPSDFKQPGXRYRSWYADRQDRFVRRFADSLGHPKVSQELRSIWIDLLAKCDASLGMKIATRLNMKPNM
